United States Patent
Bhadra et al.

(10) Patent No.: US 9,593,349 B2
(45) Date of Patent: Mar. 14, 2017

(54) FERMENTATIVE PRODUCTION OF ALCOHOLS

(71) Applicant: Butamax Advanced Biofuels LLC, Wilmington, DE (US)

(72) Inventors: Bhaskar Bhadra, Secundrabad (IN); Lixuan Huang, Hockessin, DE (US)

(73) Assignee: Butamax Advanced Biofuels LLC, Wilmington, DE (US)

(*) Notice: Subject to any disclaimer, the term of this patent is extended or adjusted under 35 U.S.C. 154(b) by 0 days.

(21) Appl. No.: 14/422,282

(22) PCT Filed: Aug. 22, 2013

(86) PCT No.: PCT/US2013/056142
§ 371 (c)(1),
(2) Date: Feb. 18, 2015

(87) PCT Pub. No.: WO2014/031831
PCT Pub. Date: Feb. 27, 2014

(65) Prior Publication Data
US 2015/0218595 A1 Aug. 6, 2015

Related U.S. Application Data

(60) Provisional application No. 61/691,839, filed on Aug. 22, 2012.

(51) Int. Cl.
| | |
|---|---|
| C12N 1/00 | (2006.01) |
| C12N 15/74 | (2006.01) |
| C12P 7/04 | (2006.01) |
| C12P 7/06 | (2006.01) |
| C12P 7/16 | (2006.01) |
| C07H 21/04 | (2006.01) |
| C07K 14/39 | (2006.01) |
| C12N 15/52 | (2006.01) |
| C07K 14/395 | (2006.01) |
| C12N 9/88 | (2006.01) |

(52) U.S. Cl.
CPC .............. *C12P 7/16* (2013.01); *C07K 14/39* (2013.01); *C07K 14/395* (2013.01); *C12N 9/88* (2013.01); *C12N 15/52* (2013.01); *C12P 7/04* (2013.01); *C12P 7/06* (2013.01); *C12Y 401/01001* (2013.01); *Y02E 50/10* (2013.01); *Y02E 50/17* (2013.01)

(58) Field of Classification Search
None
See application file for complete search history.

(56) References Cited

U.S. PATENT DOCUMENTS

| | | |
|---|---|---|
| 7,541,173 B2 | 6/2009 | Bramucci et al. |
| 7,659,104 B2 | 2/2010 | Bramucci et al. |
| 7,851,188 B2 | 12/2010 | Donaldson et al. |
| 7,910,342 B2 | 3/2011 | Liao et al. |
| 7,993,889 B1 | 8/2011 | Donaldson et al. |
| 8,017,364 B2 | 9/2011 | Bramucci et al. |
| 8,129,162 B2 | 3/2012 | Li et al. |
| 8,178,328 B2 | 5/2012 | Donaldson et al. |
| 8,188,250 B2 | 5/2012 | Bramucci et al. |
| 8,206,970 B2 | 6/2012 | Eliot et al. |
| 8,222,017 B2 | 7/2012 | Li et al. |
| 8,241,878 B2 | 8/2012 | Anthony et al. |
| 8,273,558 B2 | 9/2012 | Donaldson et al. |
| 8,283,144 B2 | 10/2012 | Donaldson et al. |
| 8,372,612 B2 | 2/2013 | Larossa et al. |
| 8,389,252 B2 | 3/2013 | Larossa |
| 8,455,224 B2 | 6/2013 | Paul |
| 8,455,225 B2 | 6/2013 | Bramucci et al. |
| 8,465,964 B2 | 6/2013 | Anthony et al. |
| 8,518,678 B2 | 8/2013 | Flint et al. |
| 8,557,562 B2 | 10/2013 | Bramucci et al. |
| 8,614,085 B2 | 12/2013 | Van Dyk et al. |
| 8,637,281 B2 | 1/2014 | Paul et al. |
| 8,637,289 B2 | 1/2014 | Anthony et al. |
| 8,652,823 B2 | 2/2014 | Flint et al. |
| 8,669,094 B2 | 3/2014 | Anthony et al. |
| 8,691,540 B2 | 4/2014 | Bramucci et al. |
| 8,735,114 B2 | 5/2014 | Donaldson et al. |
| 8,765,433 B2 | 7/2014 | Gude et al. |
| 8,785,166 B2 | 7/2014 | Anthony et al. |
| 8,795,992 B2 | 8/2014 | Bramucci et al. |
| 8,828,694 B2 | 9/2014 | Anthony et al. |
| 8,828,704 B2 | 9/2014 | Donaldson et al. |
| 8,871,488 B2 | 10/2014 | Dauner et al. |

(Continued)

FOREIGN PATENT DOCUMENTS

| | | | |
|---|---|---|---|
| JP | 2000224988 | | 8/2000 |
| JP | 2006/075 | * | 3/2006 |

(Continued)

OTHER PUBLICATIONS

Kutyna et al. Microbiological approaches to lowering ethanol concentration in wine, Trends in Food Science & Technology (2010), 21: 293-302.*

Guerzoni et al. Generation of aroma compounds in sourdough: Effects of stress exposure and lactobacilli—yeasts interactions., Food Microbiology (2007), 24: 139-148.*

T. Ayrapaaa, 1968, Higher alcohol formation by yeasts, J. Inst. Brew, vol. 74, p. 169-178.*

International Search Report and Written Opinion, mailed on Nov. 18, 2013, in International Patent Application No. PCT/US2013/056142, filed on Aug. 22, 2013.

Rodrigues-Pousada et al., "The Yap family and its role in stress response," Yeast 27:245-58 (2010).

Toone et al., "Redox control of AP-1-like factors in yeast and beyond," Oncogene 20:2336-2346 (2001).

(Continued)

*Primary Examiner* — Iqbal H Chowdhury

(57) ABSTRACT

The invention relates to the development of microorganisms capable of producing fermentation products via an engineered pathway in the microorganisms. The invention also relates to microorganisms with improved cell viability and methods to improve cell viability and cell productivity of a microorganism.

13 Claims, 3 Drawing Sheets

(56) References Cited

U.S. PATENT DOCUMENTS

| | | |
|---|---|---|
| 8,889,385 B2 | 11/2014 | Donaldson et al. |
| 8,895,307 B2 | 11/2014 | Li et al. |
| 8,906,666 B2 | 12/2014 | Alsaker et al. |
| 8,911,981 B2 | 12/2014 | Li et al. |
| 8,940,511 B2 | 1/2015 | Larossa |
| 8,945,859 B2 | 2/2015 | Donaldson et al. |
| 8,945,899 B2 | 2/2015 | Li et al. |
| 8,951,774 B2 | 2/2015 | Donaldson et al. |
| 8,951,937 B2 | 2/2015 | Flint et al. |
| 8,956,850 B2 | 2/2015 | Anthony et al. |
| 8,962,298 B2 | 2/2015 | Donaldson et al. |
| 8,969,065 B2 | 3/2015 | Anthony et al. |
| 8,980,612 B2 | 3/2015 | Donaldson et al. |
| 2008/0182308 A1 | 7/2008 | Donaldson et al. |
| 2010/0081154 A1 | 4/2010 | Flint et al. |
| 2010/0081179 A1 | 4/2010 | Anthony et al. |
| 2010/0081182 A1 | 4/2010 | Paul et al. |
| 2010/0093020 A1 | 4/2010 | Bramucci et al. |
| 2010/0120105 A1 | 5/2010 | Anthony et al. |
| 2010/0143997 A1 | 6/2010 | Buelter et al. |
| 2010/0311137 A1 | 12/2010 | Brown et al. |
| 2011/0076733 A1 | 3/2011 | Urano et al. |
| 2011/0124060 A1 | 5/2011 | Anthony et al. |
| 2011/0136192 A1 | 6/2011 | Paul et al. |
| 2011/0195505 A1 | 8/2011 | Euler et al. |
| 2011/0244536 A1 | 10/2011 | Nagarajan et al. |
| 2011/0250610 A1 | 10/2011 | Bramucci et al. |
| 2012/0058541 A1 | 3/2012 | Alsaker et al. |
| 2012/0064561 A1 | 3/2012 | Flint et al. |
| 2012/0149080 A1 | 6/2012 | Bramucci et al. |
| 2012/0196341 A1 | 8/2012 | Donaldson et al. |
| 2012/0237988 A1 | 9/2012 | Anthony et al. |
| 2012/0258873 A1 | 10/2012 | Gibson et al. |
| 2013/0035515 A1 | 2/2013 | Dobson et al. |
| 2013/0071898 A1 | 3/2013 | Anthony et al. |
| 2013/0171706 A1 | 7/2013 | Donaldson et al. |
| 2013/0203138 A1 | 8/2013 | McElvain et al. |
| 2013/0252296 A1 | 9/2013 | Maggio-Hall et al. |
| 2013/0316414 A1 | 11/2013 | Paul et al. |
| 2014/0004526 A1 | 1/2014 | Dauner et al. |
| 2014/0030782 A1 | 1/2014 | Anthony et al. |
| 2014/0030783 A1 | 1/2014 | Anthony et al. |
| 2014/0038263 A1 | 2/2014 | Flint et al. |
| 2014/0038268 A1 | 2/2014 | Flint et al. |
| 2014/0051133 A1 | 2/2014 | Govindarajan et al. |
| 2014/0051137 A1 | 2/2014 | Flint et al. |
| 2014/0057329 A1 | 2/2014 | Li et al. |
| 2014/0093930 A1 | 4/2014 | Li et al. |
| 2014/0096439 A1 | 4/2014 | Bramucci et al. |
| 2014/0141479 A1 | 5/2014 | Anthony et al. |
| 2014/0170732 A1 | 6/2014 | Bramucci et al. |
| 2014/0186910 A1 | 7/2014 | Rothman et al. |
| 2014/0186911 A1 | 7/2014 | Anthony et al. |
| 2014/0273116 A1 | 9/2014 | Kelly et al. |
| 2014/0273129 A1 | 9/2014 | Bhalla et al. |
| 2014/0308735 A1 | 10/2014 | Anthony et al. |
| 2014/0335582 A1 | 11/2014 | Donaldson et al. |
| 2014/0349349 A1 | 11/2014 | Dauner et al. |
| 2014/0377824 A1 | 12/2014 | Satagopan et al. |
| 2015/0037855 A1 | 2/2015 | Bhadra et al. |
| 2015/0111269 A1 | 4/2015 | Li et al. |
| 2015/0119608 A1 | 4/2015 | Donaldson et al. |
| 2015/0125920 A1 | 5/2015 | Anthony et al. |

FOREIGN PATENT DOCUMENTS

| | | |
|---|---|---|
| WO | WO2007012934 | 2/2007 |
| WO | WO2012045088 | 4/2012 |

OTHER PUBLICATIONS

Lushchak et al., "Oxidative stress in yeast," Biochem. 75:281-296 (2010).

Gulshan et al., "Differential oxidant tolerance determined by the key transcription Factor Yap1 is controlled by levels of Yap1-binding protein, Ybp1," JBC 286:34071-34081 (2011).

Zhang et al., "Inactivation of YAP1 enhances sensitivity of the yeast RNR3-lacZ genotoxicity testing system to a broad range of DNA-damaging agents," Toxicol. Sci. 120:310-321 (2011).

Wiatrowski et al., "Yap1 accumulates in the nucleus in response to carbon stress in Saccharomyces cerevisiae," Eukaryot. Cell 2:19-26 (2003).

Menezes et al., "Contribution of Yap1 towards Saccharomyces cerevisiae adaptation to arsenic-mediated oxidative stress," Biochem. J. 414:301-311 (2008).

Verbelen et al., "The influence of yeast oxygenation prior to brewery fermentation on yeast metabolism and the oxidative stress response," FEMS Yeast Res. 9:226-239 (2009).

Kuge et al., "YAP1 dependent activation of TRX2 is essential for the response of Saccharomyces cerevisae to oxidative stress by hydroperoxides," EMBO J. 13:655-664 (1994).

Morgan et al., "The Skn7 response regulator controls gene expression in the oxidative stress response of the budding yeast Saccharomyces cerevisiae," EMBO J. 16:1035-1044 (1997).

Lee et al., "Yap1 and Skn7 control two specialized oxidative stress response regulons in yeast," JBC 274:16040-16046 (1999).

Ma et al., "Comparative transcriptome profiling analyses during the lag phase uncover YAP1, PDR1, PDR3, RPN4, and HSF1 as key regulatory genes in genomic adaptation to the lignocellulose derived inhibitor HMF for Saccharomyces cerevisiae," BMC Genomics 11:660 (2010).

Alper et al., "Tuning genetic control through promoter engineering," PNAS 102:12678-12683 (2005).

Codon et al., "Factors which affect the frequency of sporulation and tetrad formation in Saccharomyces cerevisiae Baker's yeasts," Appl. Environ. Microbiol. 61:630-8 (1995).

Gomez-Pastor et al., "Reduction of oxidative cellular damage by overexpression of the thioredoxin TRX2 gene improves yield and quality of wine yeast dry active biomass," Microbial Cell Factories 9:9 (2010).

Paumi et al., "Ycf1p attenuates basal level oxidative stress response in Saccharomyces cerevisiae," FEBS Letters 586:847-853 (2012).

* cited by examiner

```
S288C      MSVSTAKRSLDVVSPGSLAEFEGSKSRHDEIENEHRRTGTRDGEDSEQPKKKGSKTSKKQ  60
W303       MSVSTAKRSLDVVSPGSLAEFEGSKSRHDEIENEHRRTGTRDGEDSEQPKKKGSKTSKKQ  60
Kyokai7    MSVSTAKRSLDVVSPGSLAEFEGSKSRHDEIENEHRRTSTRDGEDSEQPKKKGSKTSKKQ  60
AWRI1631   MSVSTAKRSLDVVSPGSLAEFEGSKSRHDEIENEHRRTGTRDGEDSEQPKKKGSKTSKKQ  60
Lalvin     MSVSTAKRSLDVVSPGSLAEFEGSKSRHDEIENEHRRTGTRDGEDSEQPKKKGSKTSKKQ  60
Vin13      MSVSTAKRSLDVVSPGSLAEFEGSKSRHDEIENEHRRTGTRDGEDSEQPKKKGSKTSKKQ  60
           **************************************.*********************

S288C      DLDPETKQKRTAQNRAAQRAFRERKERKMKELEKKVQSLESIQQQNEVEATFLRDQLITL 120
W303       DLDPETKQKRTAQNRAAQRAFRERKERKMKELEKKVQSLESIQQQNEVEATFLRDQLITL 120
Kyokai7    DLDPETKQKRTAQNRAAQRAFRERKERKMKELEKKVQSLESIQQQNEVEATFLRDQLITL 120
AWRI1631   DLDPETKQKRTAQNRAAQRAFRERKERKMKELEKKVQSLESIQQQNEVEATFLRDQLITL 120
Lalvin     DLDPETKQKRTAQNRAAQRAFRERKERKMKELEKKVQSLESIQQQNEVEATFLRDQLITL 120
Vin13      DLDPETKQKRTAQNRAAQRAFRERKERKMKELEKKVQSLESIQQQNEVEATFLRDQLITL 120
           ************************************************************

S288C      VNELKKYRPETRNDSKVLEYLARRDPNLHFSKNNVNHSNSEPIDTPNDDIQENVKQKMNF 180
W303       VNELKKYRPETRNDSKVLEYLARRDPNLHFSKNNVNHSNSEPIDTPNDDIQENVKQKMNF 180
Kyokai7    VNELKKYRPETRNDSKVLEYLARRDPNLHFSKNNVNHSNSEPIDTPNDDIQENVKQKMNF 180
AWRI1631   VNELKKYRPETRNDSKVLEYLARRDPNLLFSKNNVNHSNSEPIDTPNDDIQENVKQKMNF 180
Lalvin     VNELKKYRPETRNDSKVLEYLARRDPNLXFSKNNVNHSNSEPIDTPNDDIQENVKQKMNF 180
Vin13      VNELKKYRPETRNDSKVLEYLARRDPNLXFSKNNVNHSNSEPIDTPNDDIQENVKQKMNF 180
           ****************************  ******************************

S288C      TFQYPLDNDNDNDNSKNVGKQLPSPNDPSHSAPMPINQTQKKLSDATDSSSATLDSLSNS 240
W303       TFQYPLDNDNDNDNSKNVGKQLPSPNDPSHSAPMPINQTQKKLSDATDSSSATLDSLSNS 240
Kyokai7    TFQYPLDNDNDNDYSKNVGKQLPSPNDPSHSAPMPINQTQKKLSDATDSSSATLDSLSNS 240
AWRI1631   TFQYPLDNDNDNDDSKNVGKQLPSPNDPSHSAPMPINQTQKKLSDATDSSSATLDSLSNS 240
Lalvin     TFQYPLDNDNDNDDSKNVGKQLPSPNDPSHSAPMPINQTQKKLSDATDSSSATLDSLSNS 240
Vin13      TFQYPLDNDNDNDDSKNVGKQLPSPNDPSHSAPMPINQTQKKLSDATDSSSATLDSLSNS 240
           ************ ************************************************

S288C      NDVLNNTPNSSTSMDWLDNVIYTNRFVSGDDGSNSKTKNLDSNMFSNDFNFENQFDEQVS 300
W303       NDVLNNTPNSSTSMDWLDNVIYTNRFVSGDDGSNSKTKNLDSNMFSNDFNFENQFDEQVS 300
Kyokai7    NDVLNNTPNSSTSMDWLDNVIYTNRFVSGDDGSNSKTKNLDSNMFSNDFNFENQFDEQVS 300
AWRI1631   NDVLNNTPNSSTSMDWLDNVIYTNRFVSGDDGSNSKTKNLDSNMFSNDFNFENQFDEQVS 300
Lalvin     NDVLNNTPNSSTSMDWLDNVIYTNRFVSGDDGSNSKTKNLDSNMFSNDFNFENQFDEQVS 300
Vin13      NDVLNNTPNSSTSMDWLDNVIYTNRFVSGDDGSNSKTKNLDSNMFSNDFNFENQFDEQVS 300
           ************************************************************

S288C      EFCSKMNQVCGTRQCPIPKKPISALDKEVFASSSILSSNSPALTNTWESHSNITDNTPAN 360
W303       EFCSKMNQVCGTRQCPIPKKPISALDKEVFASSSILSSNSPALTNTWESHSNITDNTPAN 360
Kyokai7    EFCSKMNQVCGTRQCPIPKKPISALDKEVFASSSILSSNSPALTNTWESHSNITDNTPAN 360
AWRI1631   EFCSKMNQVCGTRQCPIPKKPISALDKEVFASSSILSSNSPALTNTWESHSNITDNTPAN 360
Lalvin     EFCSKMNQVCGTRQCPIPKKPISALDKEVFASSSILSSNSPALTNTWESHSNITDNTPAN 360
Vin13      EFCSKMNQVCGTRQCPIPKKPISALDKEVFASSSILSSNSPALTNTWESHSNITDNTPAN 360
           ************************************************************
```

FIG. 2A

```
S288C     VIATDATKYENSFSGFGRLGFDMSANHYVVNDNSTGSTDSTG------STGNKNKKNNNN 414
W303      VIATDATKYENSFSGFGRLGFDMSANHYVVNDNSTGSTDSTG------STGNKNKKNNNN 414
Kyokai7   VTATDATKYENSFSGFGRLGFDMSANHYVVNDNSTGSTDSTGSTDSTGSTGNKNKKNNNN 420
AWRI1631  VIATDATKYENSFSGFGRLGFDMSANHYVVNDNSTGSTDSTDSTGSTGSTGNKNKKNNNN 420
Lalvin    VIATDATKYENSFSGFGRLGFDMSANHYVVNDNSTGSTDSTDSTGSTGSTGNKNKKNNNN 420
Vin13     VIATDATKYENSFSGFGRLGFDMSANHYVVNDNSTGSTDSTDSTG--STGSNKNKKNNNN 418
          * ****************************************.   : .********

S288C     SDDVLPFISESPFDMNQVTNFFSPGSTGIGNNAASNTNPSLLQSSKEDIPFINANLAFPD 474
W303      SDDVLPFISESPFDMNQVTNFFSPGSTGIGNNAASNTNPSLLQSSKEDIPFINANLAFPD 474
Kyokai7   SDDVLPFISESPFDMNQVTNFFSPGSTGIGNNAASNTNPSLLQSSKEDIPFINANLAFPD 480
AWRI1631  SDDVLPFISESPFDMNQVTNFFSPGSTGIGNNAASNTNPSLLQSSKEDIPFINANLAFPD 480
Lalvin    SDDVLPFISESPFDMNQVTNFFSPGSTGIGNNAASNTNPSLLQSSKEDIPFINANLAFPD 480
Vin13     SDDVLPFISESPFDMNQVTNFFSPGSTGIGNNAASNTNPSLLQSSKEDIPFINANLAFPD 478
          ************************************************************

S288C     DNSTNIQLQPFSESQSQNKFDYDMFFRDSSKEGNNLFGEFLEDDDDDKKAANMSDDESSL 534
W303      DNSTNIQLQPFSESQSQNKFDYDMFFRDSSKEGNNLFGEFLEDDDDDKKAANMSDDESSL 534
Kyokai7   DNSTNIQLQPFSESQSQNKFDYDMFFRDSSKEGNNLFGEFLEDDDDDKKAANMSDDESSL 540
AWRI1631  DNSTNIQLQPFSESQSQNKFDYDMFFRDSSKEGNNLFGEFLEDDDDDKKAANMSDDESSL 540
Lalvin    DNSTNIQLQPFSESQSQNKFDYDMFFRDSSKEGNNLFGEFFRG----------------- 523
Vin13     DNSTNIQLQPFSESQSQNKFDYDMFFRDSSKEGNNLFGEFLEDDDDDKKAANMSDDESSL 538
          ****************************************:..

S288C     IKNQLINEEPELPKQYLQSVPGNESEISQKNGSSLQNADKINNGNDNDNDNDVVPSKEGS 594
W303      IKNQLINEEPELPKQYLQSVPGNESEISQKNGSSLQNADKINNGNDNDNDNDVVPSKEGS 594
Kyokai7   IKNQLINEEPELPKQYLQSVPGNESEISQKNGSSLQNADKINNGNDNDNDNDVVPSKEGS 600
AWRI1631  IKNQLINEEPELPKQYLQSVPGNESEISQKNGSSLQNADKINNGNDNDNDNDVVPSKEGS 600
Lalvin    ------------------------------------------------------------
Vin13     IKNQLINEEPELPKQYLQSVPGNE----KRN----------------------------- 565

S288C     LLRCSEIWDRITTHPKYSDIDVDGLCSELMAKAKCSERGVVINAEDVQLALNKHMN 650
W303      LLRCSEIWDRITTHPKYSDIDVDGLCSELMAKAKCSERGVVINAEDVQLALNKHMN 650
Kyokai7   LLRCSEIWDRITTHPKYSDIDVDGLCSELMAKAKCSERGVVINAEDVQLALNKHMN 656
AWRI1631  LLRCSEIWDRITTHPKYSDIDVDGLCSELMAKAKCSERGVVINAEDVQLALNKHMN 656
Lalvin    --------------------------------------------------------
Vin13     LTKKMAVVCRMLTRSIMAMITIMITMSFHLRKALY-------------------- 600
```

| Strain | SEQ ID NO: |
|---|---|
| S288C | 11 |
| W303 | 368 |
| Kyokai7 | 8 |
| AWRI1631 | 7 |
| Lalvin | 9 |
| Vin13 | 10 |

FIG. 2B

FERMENTATIVE PRODUCTION OF ALCOHOLS

This application claims the benefit of U.S. Provisional Application No. 61/691,839, filed on Aug. 22, 2012; the entire contents of which are herein incorporated by reference.

The Sequence Listing associated with this application is filed in electronic form via EFS-Web and hereby incorporated by reference into the specification in its entirety.

FIELD OF THE INVENTION

The invention relates to the development of microorganisms capable of producing fermentation products via an engineered pathway in the microorganisms. The invention also relates to microorganisms with improved cell viability and methods to improve cell viability and cell productivity of a microorganism.

BACKGROUND OF THE INVENTION

A number of chemicals and consumer products may be produced utilizing fermentation as the manufacturing process. For example, alcohols such as ethanol and butanol have a variety of industrial and scientific applications such as fuels, reagents, and solvents. Butanol is an important industrial chemical useful as a fuel additive, as a feedstock chemical in the plastics industry, and as a food grade extractant in the food and flavor industry. Each year 10 to 12 billion pounds of butanol are produced by chemical syntheses using starting materials derived from petrochemicals. The production of butanol or butanol isomers from materials such as plant-derived materials could minimize the use of petrochemicals and would represent an advance in the art. Furthermore, production of chemicals and fuels using plant-derived materials or other biomass sources would provide eco-friendly and sustainable alternatives to petrochemical processes.

Techniques such as genetic engineering and metabolic engineering may be utilized to modify a microorganism to produce a certain product from plant-derived materials or other sources of biomass. The microorganism may be modified, for example, by the insertion of genes such as the insertion of genes encoding a biosynthetic pathway, deletion of genes, or modifications to regulatory elements such as promoters. A microorganism may also be engineered to improve cell productivity and yield, to eliminate by-products of biosynthetic pathways, and/or for strain improvement. Examples of microorganisms expressing engineered biosynthetic pathways for producing butanol isomers, including isobutanol, are described in U.S. Pat. Nos. 7,851,188 and 7,993,889.

However, exposure to alcohols such as ethanol and butanol during fermentation can have a negative impact on cell viability, cell productivity, and product yield. The accumulation of these alcohols can inhibit cell growth and eventually affect the fermentative production of these alcohols. As such, there is a need to develop microorganisms that exhibit improved cell growth and production in the presence of these alcohols as well as methods that maintain and/or improve cell viability and cell productivity.

The present invention is directed to the development of such methods as well as the development of microorganisms with improved cell viability and cell productivity and capable of producing fermentation products via an engineered pathway in the microorganisms.

SUMMARY OF THE INVENTION

The present invention is directed to a recombinant host cell comprising modified yeast activator protein and/or yeast activator protein activity. In some embodiments, the recombinant host cell may produce a fermentation product such as an alcohol. In some embodiments, the recombinant host cell may comprise a modification in a polynucleotide encoding a polypeptide having yeast activator protein activity. In some embodiments, the recombinant host cell may comprise a deletion, mutation, insertion, substitution, and/or overexpression of a polynucleotide encoding a polypeptide having yeast activator protein activity. In some embodiments, the recombinant host cell may comprise a deletion, mutation, insertion, substitution, and/or overexpression of one or more polynucleotides encoding a polypeptide having yeast activator protein activity. In some embodiments, the recombinant host cell may comprise one or more deletions, mutations, insertions, and/or substitutions of a polynucleotide encoding a polypeptide having yeast activator protein activity. In some embodiments, the recombinant host cell may comprise one or more deletions, mutations, insertions, and/or substitutions of one or more polynucleotides encoding a polypeptide having yeast activator protein activity. In some embodiments, the polypeptide having yeast activator protein activity may be Yap1, Yap2, Yap3, Yap4, Yap5, Yap6, Yap7, or Yap8.

In some embodiments, the recombinant host cell may comprise one or amino acid substitutions in a polypeptide having yeast activator protein activity. In some embodiments, the recombinant host cell may comprise an amino acid substitution in a Yap1 polypeptide at residues 80, 132, 168, 237, 254, 257, 297, 302, 367, 404, 411, 444, 487, 498, 499, 548, 584, 617, and/or 636, or combinations thereof. In some embodiments, the recombinant host cell may comprise one or more amino acid substitutions in a Yap1 polypeptide at residues 80, 132, 168, 237, 254, 257, 297, 302, 367, 404, 411, 444, 487, 498, 499, 548, 584, 617, and/or 636, or combinations thereof. In some embodiments, the amino acid substitution may be a polar amino acid, nonpolar amino acid, basic amino acid, or acidic amino acid. In some embodiments, the recombinant host cell may comprise one or more sequences selected from SEQ ID NO: 2, 3, 4, 5, 6, 7, 8, 9, 10, 11, 12, 13, 14, 15, 16, 17, 18, 19, 20, 21, 22, 23, 24, 25, 26, and 27. In some embodiments, the recombinant host cell may comprise one or more amino acid insertions in a polypeptide having yeast activator protein activity. In some embodiments, the recombinant host cell may comprise a yeast activator protein comprising one or more amino acid insertions of tripeptide repeat units selected from Ser-Thr-Asp and Ser-Asp-Gly.

In some embodiments, the recombinant host cell may further comprise a butanol biosynthetic pathway (e.g., an engineered butanol pathway). In some embodiments, the butanol biosynthetic pathway may be an isobutanol biosynthetic pathway. In some embodiments, the isobutanol biosynthetic pathway may comprise a polynucleotide encoding a polypeptide that catalyzes a substrate to product conversion selected from the group consisting of:
(a) pyruvate to acetolactate;
(b) acetolactate to 2,3-dihydroxyisovalerate;
(c) 2,3-dihydroxyisovalerate to α-ketoisovalerate;
(d) α-ketoisovalerate to isobutyraldehyde; and
(e) isobutyraldehyde to isobutanol.

In some embodiments, the isobutanol biosynthetic pathway may comprise a polynucleotide encoding a polypeptide that catalyzes a substrate to product conversion selected from the group consisting of:
(a) pyruvate to acetolactate;
(b) acetolactate to 2,3-dihydroxyisovalerate;
(c) 2,3-dihydroxyisovalerate to α-ketoisovalerate;
(d) α-ketoisovalerate to valine;
(e) valine to isobutylamine;
(f) isobutylamine to isobutyraldehyde; and
(g) isobutyraldehyde to isobutanol.

In some embodiments, the isobutanol biosynthetic pathway may comprise a polynucleotide encoding a polypeptide that catalyzes a substrate to product conversion selected from the group consisting of:
(a) pyruvate to acetolactate;
(b) acetolactate to 2,3-dihydroxyisovalerate;
(c) 2,3-dihydroxyisovalerate to α-ketoisovalerate;
(d) α-ketoisovalerate to isobutyryl-CoA;
(e) isobutyryl-CoA to isobutyraldehyde; and
(f) isobutyraldehyde to isobutanol.

In some embodiments, the isobutanol biosynthetic pathway may comprise one or more polynucleotides encoding polypeptides having acetolactate synthase, acetohydroxy acid reductoisomerase, acetohydroxy acid dehydratase, keto acid decarboxylase, alcohol dehydrogenase, keto acid reductoisomerase, dihydroxy acid dehydratase, valine dehydrogenase, valine dehydrogenase, omega transaminase, ketoisovalerate decarboxylase, and/or aldehyde dehydrogenase activity.

In some embodiments, the butanol biosynthetic pathway may be a 1-butanol biosynthetic pathway. In some embodiments, the 1-butanol biosynthetic pathway may comprise a polynucleotide encoding a polypeptide that catalyzes a substrate to product conversion selected from the group consisting of:
(a) acetyl-CoA to acetoacetyl-CoA;
(b) acetoacetyl-CoA to 3-hydroxybutyryl-CoA;
(c) 3-hydroxybutyryl-CoA to crotonyl-CoA;
(d) crotonyl-CoA to butyryl-CoA;
(e) butyryl-CoA to butyraldehyde; and
(f) butyraldehyde to 1-butanol.

In some embodiments, the 1-butanol biosynthetic pathway may comprise one or more polynucleotides encoding polypeptides having acetyl-CoA acetyltransferase, 3-hydroxybutyryl-CoA dehydrogenase, crotonase, butyryl-CoA dehydrogenase, butyraldehyde dehydrogenase, and/or butanol dehydrogenase activity.

In some embodiments, the butanol biosynthetic pathway may be a 2-butanol biosynthetic pathway. In some embodiments, the 2-butanol biosynthetic pathway may comprise a polynucleotide encoding a polypeptide that catalyzes a substrate to product conversion selected from the group consisting of:
(a) pyruvate to alpha-acetolactate;
(b) alpha-acetolactate to acetoin;
(c) acetoin to 3-amino-2-butanol;
(d) 3-amino-2-butanol to 3-amino-2-butanol phosphate;
(e) 3-amino-2-butanol phosphate to 2-butanone; and,
(f) 2-butanone to 2-butanol.

In some embodiments, the 2-butanol biosynthetic pathway may comprise a polynucleotide encoding a polypeptide that catalyzes a substrate to product conversion selected from the group consisting of:
(a) pyruvate to alpha-acetolactate;
(b) alpha-acetolactate to acetoin;
(c) acetoin to 2,3-butanediol;
(d) 2,3-butanediol to 2-butanone; and
(e) 2-butanone to 2-butanol.

In some embodiments, the 2-butanol biosynthetic pathway may comprise polynucleotides encoding polypeptides having acetolactate synthase, acetolactate decarboxylase, butanediol dehydrogenase, dial dehydratase, acetonin aminase, aminobutanol kinase, aminobutanol phosphate phosphorylase, and/or butanol dehydrogenase activity.

In some embodiments, the biosynthetic pathway may be a 2-butanone biosynthetic pathway. In some embodiments, the 2-butanone biosynthetic pathway may comprise a polynucleotide encoding a polypeptide that catalyzes a substrate to product conversion selected from the group consisting of:
(a) pyruvate to alpha-acetolactate;
(b) alpha-acetolactate to acetoin;
(c) acetoin to 3-amino-2-butanol;
(d) 3-amino-2-butanol to 3-amino-2-butanol phosphate; and
(e) 3-amino-2-butanol phosphate to 2-butanone.

In some embodiments, the 2-butanone biosynthetic pathway may comprise a polynucleotide encoding a polypeptide that catalyzes a substrate to product conversion selected from the group consisting of:
(a) pyruvate to alpha-acetolactate;
(b) alpha-acetolactate to acetoin;
(c) acetoin to 2,3-butanediol; and
(d) 2,3-butanediol to 2-butanone.

In some embodiments, the 2-butanone biosynthetic pathway may comprise polynucleotides encoding polypeptides having acetolactate synthase, acetolactate decarboxylase, butanediol dehydrogenase, acetonin aminase, aminobutanol kinase, aminobutanol phosphate phosphorylase, and/or diol dehydratase activity.

In some embodiments, the engineered butanol pathway of the microorganism comprises at least one polypeptide selected from the group of enzymes having the following Enzyme Commission Numbers: EC 2.2.1.6, EC 1.1.1.86, EC 4.2.1.9, EC 4.1.1.72, EC 1.1.1.1, EC 1.1.1.265, EC 1.1.1.2, EC 1.2.4.4, EC 1.3.99.2, EC 1.2.1.57, EC 1.2.1.10, EC 2.6.1.66, EC 2.6.1.42, EC 1.4.1.9, EC 1.4.1.8, EC 4.1.1.14, EC 2.6.1.18, EC 2.3.1.9, EC 2.3.1.16, EC 1.1.130, EC 1.1.1.35, EC 1.1.1.157, EC 1.1.1.36, EC 4.2.1.17, EC 4.2.1.55, EC 1.3.1.44, EC 1.3.1.38, EC 5.4.99.13, EC 4.1.1.5, EC 2.7.1.29, EC 1.1.1.76, EC 1.2.1.57, and EC 4.2.1.28.

In some embodiments, the engineered butanol pathway of the microorganism comprises at least one polypeptide selected from the following group of enzymes: acetolactate synthase, acetohydroxy acid isomeroreductase, acetohydroxy acid dehydratase, branched-chain alpha-keto acid decarboxylase, branched-chain alcohol dehydrogenase, acylating aldehyde dehydrogenase, branched-chain keto acid dehydrogenase, butyryl-CoA dehydrogenase, butyraldehyde dehydrogenase, transaminase, valine dehydrogenase, valine decarboxylase, omega transaminase, acetyl-CoA acetyltransferase, 3-hydroxybutyryl-CoA dehydrogenase, crotonase, butyryl-CoA dehydrogenase, isobutyryl-CoA mutase, acetolactate decarboxylase, acetonin aminase, butanol dehydrogenase, butyraldehyde dehydrogenase, acetoin kinase, acetoin phosphate aminase, aminobutanol phosphate phospholyase, aminobutanol kinase, butanediol dehydrogenase, and butanediol dehydratase.

In some embodiments, one or more of the substrate to product conversions utilizes NADH or NADPH as a cofactor. In some embodiments, the NADH is the preferred cofactor for either step b or e or both.

In some embodiments, the recombinant host cell may further comprise a modification in a polynucleotide encoding a polypeptide having pyruvate decarboxylase activity. In some embodiments, the recombinant host cell may comprise a deletion, mutation, insertion, and/or substitution in an endogenous polynucleotide encoding a polypeptide having pyruvate decarboxylase activity. In some embodiments, the recombinant host cell may comprise a deletion, mutation, insertion, and/or substitution in one or more endogenous polynucleotides encoding a polypeptide having pyruvate decarboxylase activity. In some embodiments, the recombinant host cell may comprise one or more deletions, mutations, insertions, and/or substitutions in an endogenous polynucleotide encoding a polypeptide having pyruvate decarboxylase activity. In some embodiments, the recombinant host cell may comprise one or more deletions, mutations, insertions, and/or substitutions in one or more endogenous polynucleotides encoding a polypeptide having pyruvate decarboxylase activity. In some embodiments, the polypeptide having pyruvate decarboxylase activity may be PDC1, PDC5, PDC6, or combinations thereof. In some embodiments, the endogenous polynucleotide encoding a polypeptide having pyruvate decarboxylase activity may be PDC1, PDC5, PDC6, or combinations thereof. In some embodiments, the recombinant host cell may comprise a deletion, mutation, insertions, and/or substitution in one or more endogenous polynucleotides encoding FRA2, GPD2, BDH1, and YMR.

In some embodiments, the recombinant host cell may be a yeast cell. In some embodiments, the yeast cell may be a member of a genus of yeast such as *Saccharomyces, Schizosaccharomyces, Hansenula, Candida, Kluyveromyces, Yarrowia, Issatchenkia,* or *Pichia*. In some embodiments, the microorganism is *Saccharomyces cerevisiae*.

The present invention is also directed to a recombinant host cell comprising one or more modified components of a stress pathway and/or modified activity of components of a stress pathway. In some embodiments, the recombinant host cell may produce a fermentation product such as an alcohol. In some embodiments, the recombinant host cell may comprise a modification in a polynucleotide encoding a polypeptide having activity of components of a stress pathway. In some embodiments, the recombinant host cell may comprise a deletion, mutation, insertion, and/or substitution in an endogenous polynucleotide encoding a polypeptide having activity of components of a stress pathway. In some embodiments, the recombinant host cell may comprise a deletion, mutation, insertion, and/or substitution in one or more endogenous polynucleotides encoding a polypeptide having activity of components of a stress pathway. In some embodiments, the recombinant host cell may comprise one or more deletions, mutations, insertions, and/or substitutions in an endogenous polynucleotide encoding a polypeptide having activity of components of a stress pathway. In some embodiments, the recombinant host cell may comprise one or more deletions, mutations, insertions, and/or substitutions in one or more endogenous polynucleotides encoding a polypeptide having activity of components of a stress pathway. In some embodiments, the polypeptide may be Yap1, Yap2, Yap3, Yap4, Yap5, Yap6, Yap7, Yap8, Ybp1, Trx2, Gsh1, Gsh2, Trr1, Gpx2, Tsa1, Ahp1, Glr1, or combinations thereof.

The present invention is also directed to a method for improving cell viability comprising modifying one or more components of a stress response pathway. In some embodiments, the one or more components of a stress response pathway may be Yap1, Yap2, Yap3, Yap4, Yap5, Yap6, Yap7, Yap8, Ybp1, Trx2, Gsh1, Gsh2, Trr1, Gpx2, Tsa1, Ahp1, Glr1, or combinations thereof.

The present invention is also directed to a process for producing an alcohol comprising (a) providing a recombinant host cell as described herein, wherein the host cell produces an alcohol; (b) contacting the recombinant host cell with one or more carbon substrates under conditions wherein the alcohol is produced; and (c) recovering the alcohol. In some embodiments, the alcohol may be selected from methanol, ethanol, propanol, butanol, pentanol, and hexanol. In some embodiments, butanol may be selected from 1-butanol, 2-butanol, 2-butanone, isobutanol, tert-butanol, or mixtures thereof.

The present invention is also directed to an isolated polynucleotide comprising a nucleotide sequence encoding the polypeptide set forth in SEQ ID NO: 2-38. Another embodiment of the present invention is directed to isolated polynucleotide comprising a nucleotide sequence encoding a variant of the polypeptide set forth in SEQ ID NO: 19-27. The present invention is also directed to an isolated polynucleotide comprising a nucleotide sequence selected from the group consisting of: a) a nucleotide sequence encoding the polypeptide set forth in SEQ ID NO: 2-38; b) a nucleotide sequence encoding a polypeptide having at least 95% sequence identity to SEQ ID NO: 2-38; wherein the polynucleotide encodes a polypeptide that when expressed in a host cell thereof improves the tolerance of the host cell to oxidative stress.

Other embodiments of the present invention include an expression cassette comprising the isolated polynucleotide of SEQ ID NO: 2-38, wherein the polynucleotide is operably linked to a promoter; and a composition comprising a recombinant host cell described herein.

The present invention is also directed to a composition comprising a recombinant host cell as described herein.

In some embodiments, the carbon substrate is one or more of the following: oligosaccharides, polysaccharides, monosaccharides, and/or mixtures thereof. In some embodiments, the carbon substrate is one or more of the following: fructose, glucose, lactose, maltose, galactose, sucrose, starch, cellulose, feedstocks, ethanol, lactate, succinate, glycerol, corn mash, sugar cane, biomass, a C5 sugar such as xylose and arabinose, and/or mixtures thereof.

In some embodiments, the first contacting with the carbon substrate occurs in the presence of an extractant. In some embodiments, the first contacting with the carbon substrate occurs in anaerobic conditions. In some embodiments, the first contacting with the carbon substrate occurs in microaerobic conditions. In some embodiments, recycling occurs in anaerobic conditions. In some embodiments, recycling occurs in microaerobic conditions.

DESCRIPTION OF THE DRAWINGS

FIGS. 2A and 2B illustrate the sequence alignment of Yap1 from several strains of *Saccharomyces cerevisiae*.

DESCRIPTION OF THE INVENTION

Figure 1:
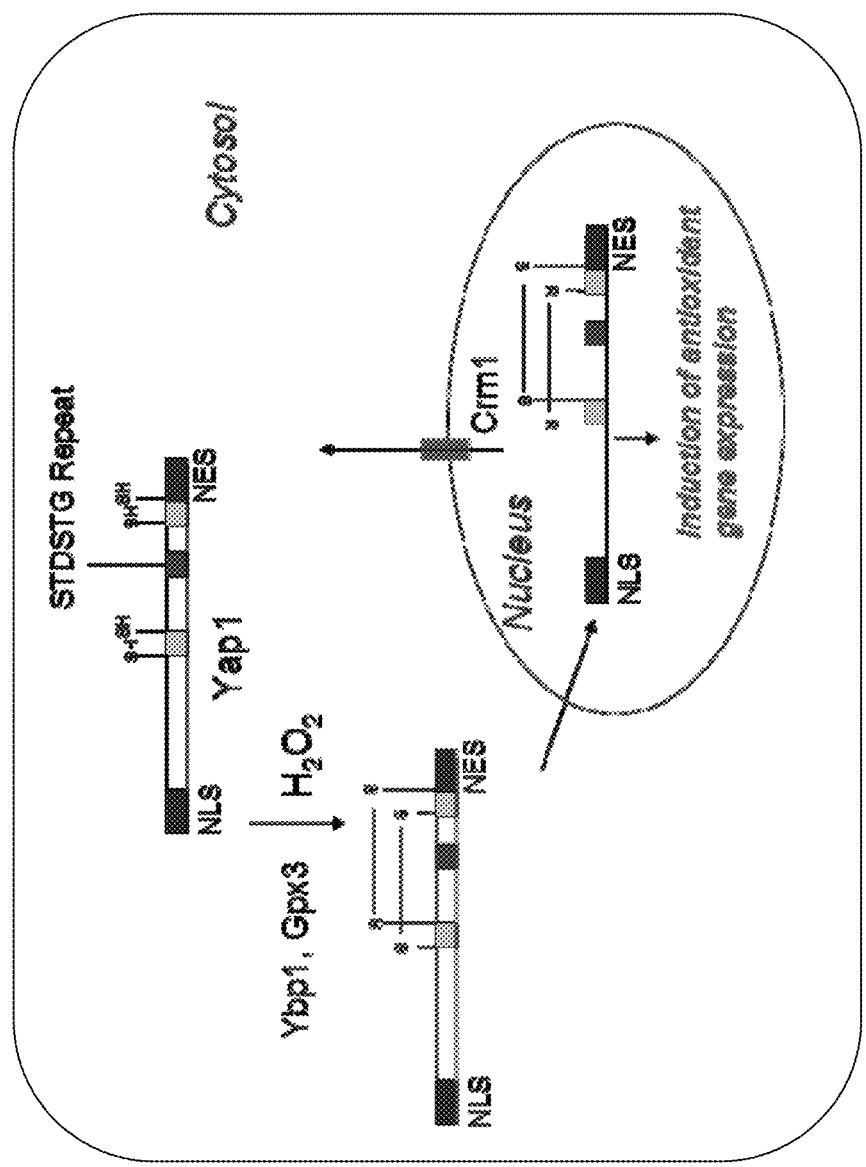
FIG. 1 illustrates the regulation of Yap1 in the oxidative stress response pathway.

This invention is directed to microorganisms that produce fermentation products and optimizations for producing fermentation products such as butanol at high rate and titers with advantaged economic process conditions.

During fermentative production of some fermentation products such as alcohols, microorganisms may be subjected to various stress conditions including, for example, product toxicity (e.g., alcohol toxicity), oxidative stress, osmotic stress, and fluctuations in pH, temperature, and nutrient availability. The impact of these stress conditions can cause an inhibition of cell growth and decreased cell viability which can ultimately lead to a reduction in fermentation productivity and product yield. The ability to adapt to these stress conditions by adjusting the metabolic processes of the microorganism is advantageous to maintain efficient production. For example, when exposed to a particular stressing agent, a microorganism may response to these stress conditions by modifying certain metabolic processes such as growth, signal transduction, transcription, and/or posttranslational activities.

Yeast activator proteins (Yap) are basic leucine zipper (b-ZIP) transcription factors that are implicated in various stress responses. There are a number of yeast activator proteins including Yap1, which functions as a modulator of oxidative stress in *Saccharomyces cerevisiae*. Yap1 also plays a role in the cellular response to amino acid starvation and cytotoxic agents such as hydrogen peroxide. Other yeast activator proteins include Yap2 which has a role in response to toxic compounds such as cadmium, Yap4 and Yap6 are involved in the response to osmotic stress, Yap5 is involved in iron metabolism, and Yap8 is involved in arsenic detoxification (see, e.g., Rodrigues-Pousada, et al., Yeast 27:245-258, 2010). Additional yeast activator proteins include Yap3 and Yap7.

Yap1 regulates the expression of genes associated with tolerance to oxidative stress by activating transcription via binding to specific DNA sequences localized in the promoters of these regulated genes. The consensus element, known as the Yap1 response element (YRE), is 5'-TT/GAC/GTAA, and has been identified in the promoters of γ-glutamylcysteine synthase 1 (GSH1), thioredoxin 2 (TRX2), yeast cadmium factor gene (YCF1), glutathione reductase (GLR1), and multidrug resistance transporter (ATR1).

Control of Yap1-mediated gene regulation is accomplished through its cellular relocation (see FIG. 1). Yap1 is located in both the cytoplasm and nucleus, and in the absence of oxidative stress, Yap1 enters the nucleus at a relatively low basal rate compared with its nuclear export. The nuclear export of Yap1 is mediated by the nuclear export protein, Cmr1. Cmr1 binds to the nuclear export signal (NES) that overlaps with a cysteine-rich domain (CRD) located in the C-terminal domain of Yap1. The reduced form of Yap1 binds with Cmr1 forming a Yap1-Cmr1 complex, and is then exported from the nucleus to the cytoplasm. Oxidation of the cysteine residues in the CRD prevents the interaction of Yap1 with Cmr1, resulting in the accumulation of Yap1 in the nucleus and enhanced expression of the genes associated with tolerance to oxidative stress.

Deactivation of Yap1 is mediated by a thioredoxin system, suggesting that localization of Yap1 is regulated by a negative feedback loop. Thioredoxin reduces the intramolecular disulfide bonds, resulting in the cytoplasmic relocation of Yap1. That is, Cmr1 can bind to the reduced Yap1 and the Yap1-Cmr1 complex is exported to the cytoplasm (see, e.g., Toone, et al., Oncogene 20:2336-2346, 2001). Of note, there are several mechanisms for activation and deactivation of Yap1, and these mechanisms appear to depend, for example, on the stress conditions (e.g., the presence of oxidants).

As an example of a Yap1 activation mechanism, in the presence of hydrogen peroxide ($H_2O_2$), glutathione-dependent peroxidase (Gpx3) is oxidized via a cysteine residue to form a sulfoxide. This sulfoxide group of Gpx3 interacts with a cysteine residue in the C-terminal CRD (C-CRD) of Yap1 in the presence of a Yap1-binding protein (Ybp1), forming a disulfide bond between Gpx3 and Yap1. Reduction of this intermolecular disulfide bond leads to the release of Gpx3 and the formation of intramolecular disulfide bonds in Yap1 (i.e., disulfide bonds form between cysteine residues in the C-CRD and cysteine residues in the N-terminal CRD, N-CRD) that masks the NES site, thus interfering with the binding of Cmr1 (see, e.g., Lushchak, Biochem. 75:281-296, 2010; Gulshan, et al., J. Biol. Chem. 286:34071-34081, 2011).

Another oxidizing agent, diamide, appears to oxidize particular cysteine residues in the CRD of Yap1 and thus inhibit association with Crm1 exportin. Ybp1 is not required for diamide resistance; however, studies indicate that Ybp1 is rate-limiting for Yap1 oxidative folding during $H_2O_2$ stress in *Candida glabrata* (Gulshan, et al., 2011, supra). Overproduction of CgYbp1 (*Candida glabrata* Ybp1) resulted in an elevated $H_2O_2$ tolerance in *Candida glabrata* indicating that the role of Ybp1 in $H_2O_2$ resistance has been evolutionarily conserved. In other studies, deletion of YAP1 caused an increased cellular sensitivity to a variety of DNA damaging agents (see, e.g., Zhang, et al., Toxicol. Sci. 120:310-321, 2011). In addition to oxidative stress, Yap1 also accumulated in the nucleus of cells transferred from a glucose-rich medium to medium containing glycerol or no carbon source, and cells exposed to heavy metals such as arsenic (see, e.g., Wiatrowski, et al., Eukaryot. Cell 2:19-26, 2003; Menezes, et al., Biochem. J. 414:301-311, 2008). During pre-oxygenation in brewery fermentations, the expression of YAP1 increased in the early stage of oxygenation indicating the development of a stress response and resistance against stress conditions (see, e.g., Verbelen, et al., FEMS Yeast Res. 9: 226-239, 2009).

Other genes involved in response to oxidative stress include, for example, thioredoxin 2 (TRX2), γ-glutamylcysteine synthase 1 (GSH1), glutathione synthase (GSH2), thioredoxin reductase (TRR1), glutathione peroxidase (GPX2), glutathione oxidoreductase (GLR1), thioredoxin peroxidase (TSA1), and alkylhydroperoxide reductase (AHP1); and TRR1, TRX2, GSH1, and GLR1 are regulated by Yap1 (see, e.g., Kuge, et al., EMBO J. 13:655-664, 1994; Morgan, et al., EMBO J. 16:1035-1044, 1997; Lee, et al., J. Biol. Chem. 274:16040-16046, 1999). In addition, YAP1 and other transcription factors such as PDR1, PDR3, RPN4, and HSF1 appear to play key regulatory roles for the global adaptation of *Saccharomyces cerevisiae* to lignocellulosic-derived inhibitors (see, e.g., Ma, et al., BMC Genomics 11:660, 2010).

The YAP1 gene is highly conserved among various species of *Saccharomyces cerevisiae*. However, there is less homology between *Saccharomyces cerevisiae* and other fungi, with most homology located at the N- and C-terminus. The YAP1 gene contains a nuclear localization signal sequence at its N-terminus (NLS) and an NES sequence at the C-terminus. Sequence alignment of YAP1 genes from several *Saccharomyces cerevisiae* strains revealed a sequence motif that differentiates the different Yap1 proteins. This motif consists of tripeptide repeat units of Ser-Thr-Asp ("STD") or Ser-Thr-Gly ("STG"). For example, Yap1 from yeast strain, CEN.PK 113-7D consists of four tripeptide units (amino acid residues S394 to G405) and Yap1 from yeast strain, *Saccharomyces cerevisiae* PNY827 (ATCC® Patent Deposit Designation: PTA-12105) consists of six tripeptide units (amino acid residues S394 to G411). The nucleotide sequence of this tripeptide repeat region is either duplicate or triplicate of the sequence 5'-atgcactgg-tagcactg-3'(SEQ ID NO: 1). The YAP1 gene from CEN.PK 113-7D contains a duplication of this sequence motif from nt 1178 to nt 1213, and the YAP1 gene from PNY827 contains an additional copy of the sequence repeat from nt 1214 to nt 1231. This translates into the additional two tripeptide units in Yap1 from PNY827.

A summary of the number of STD/STG repeat motifs from several Saccharomyces cerevisiae strains is listed in Table 1 and the sequence alignment of Yap1 from several Saccharomyces cerevisiae strains is shown in FIGS. 2A and 2B. The repeat number identified in Table 1 is the total number of tripeptide units of either Ser-Thr-Asp or Ser-Thr-Gly sequence motifs.

TABLE 1

| Strain | Description | STD/STG repeat no. |
| --- | --- | --- |
| AWRI1631 | Wine | 6 |
| AWRI796 | Wine | 7 |
| CLIB215 | Baker's Yeast | 6 |
| EC1118 | Champagne | 5 |
| EC9-8 | Cd Resistant Clone | 4 |
| Foster B | Brewing (ale) | 4 |
| Foster O | Brewing (ale) | 4 |
| JAY291 | Haploid Derivative of PE-2 (sugar cane fermentation) | 4 |
| Kyokai 7 | Sake | 6 |
| Lalvin QA23 | Wine | 6 |
| PW5 | Raphia Palm Wine | 4 |
| RM11-1a | Natural isolate from a California vinyard | 7 |
| UC5 | Sake | 6 |
| Vin 13 | Wine | 5 |
| YJM789 | Isolated from the lung of an AIDS patient | 4 |
| YJM269 | Isolated from grapes | 4 |
| S288C | Saccharomyces cerevisiae lab strain | 4 |
| W303 | Saccharomyces cerevisiae lab strain | 4 |
| CEN.PK 113-7D | CBS 8340 | 4 |

Several laboratory strains, including S288C, W303, and CEN.PK 113-7D each have four tripeptide units. Strains associated with ethanol production, for example, wine and sake strains, tend to have higher number of tripeptide units, ranging from five to seven tripeptide units. Some beer brewing strains (Foster B and Foster O) and a sugar cane fermentation strain (JAY291) each have four tripeptide units. Due to the high alcohol content of wine and sake strains, it is likely that the higher number of tripeptide units may be associated with higher stress tolerance and the robustness of the fermentation strains. The increased number of tripeptide units may have evolved through certain lineages of alcohol fermentation strains as a mechanism for increasing strain tolerance, growth, and/or productivity.

Transferring a YAP1 gene with higher number of tripeptide units (e.g., 6-7 tripeptide units) to a strain with a YAP1 gene with low number of tripeptide units may result in increased stress tolerance, growth, and/or productivity. Stress tolerance may include increased resistance towards alcohols (e.g., ethanol, butanol, isobutanol) and/or oxidative stress. For example, expressing YAP1 from PNY827 which has six tripeptide units in JA291 which has four tripeptide units may improve tolerance and/or productivity in fermentative production of alcohols (e.g., ethanol, butanol, isobutanol) or other fermentative products. In addition, increasing the number of tripeptide units (e.g., 8-12 tripeptide units) may further increase the stress tolerance of the host strains. Single or multiple mutations of residues in this repeat sequence region may be generated by site-directed mutagenesis or error-prone PCR to produce a diverse library of YAP1 mutant genes. Strains with improved stress tolerance may be selected by screening or selection using methods known by those skilled in the art. Some lineages of yeast fermentation strains (e.g., JA291) may have evolved additional mechanisms for robustness, tolerance, and/or productivity. Combining a more active YAP1 mutant with the intrinsic stress tolerance mechanism of these strains may provide yeast strains with improved productivity, and these improved yeast strains may be used in industrial fermentative processes.

With renewed interest in sustainable biofuels as an alternative energy source and the desire for the development of efficient and environmentally-friendly production methods, alcohol production using fermentation processes is a viable option to the current chemical synthesis processes. However, some microorganisms that produce alcohol (e.g., ethanol, butanol) in certain yields also have low alcohol toxicity thresholds. Thus, the development of fermentation processes for the commercial production of alcohols has been limited by alcohol toxicity. As described above, alcohol toxicity can produce a stress response in the microorganism leading to, for example, an inhibition of cell growth and decreased cell viability.

The present invention is directed to microorganisms with improved cell viability, improved productivity, and/or increased stress tolerance (e.g., tolerance to alcohol). In some embodiments, microorganisms may be engineered to exhibit improved cell viability, improved productivity, and/or increased stress tolerance through application of one or more modifications that alter expression and/or activity of one or more components of a stress response pathway. In some embodiments, the stress response pathway is the oxidative stress response pathway. In some embodiments, the one or more components of the stress response pathway may be a yeast activator protein (Yap). In some embodiments, the yeast activator protein may be Yap1. In some embodiments, the yeast activator protein may be Yap2. In some embodiments, the yeast activator protein may be Yap3. In some embodiments, the yeast activator protein may be Yap4. In some embodiments, the yeast activator protein may be Yap5. In some embodiments, the yeast activator protein may be Yap6. In some embodiments, the yeast activator protein may be Yap7. In some embodiments, the yeast activator protein may be Yap8. In some embodiments, the one or more components of the stress response pathway may be Ybp1. In some embodiments, the one or more components of the stress response pathway may be Trx2. In some embodiments, the one or more components of the stress response pathway may be Gsh1. In some embodiments, the one or more components of the stress response pathway may be Gsh2. In some embodiments, the one or more components of the stress response pathway may be Trr1. In some embodiments, the one or more components of the stress response pathway may be Gpx2. In some embodiments, the one or more components of the stress response pathway may be Tsa1. In some embodiments, the one or more components of the stress response pathway may be Ahp1. In some embodiments, the one or more components of the stress response pathway may be Glr1.

In some embodiments, the one or more modifications that alter expression and/or activity may be an increase in the expression of one or more genes encoding one or more components of the stress response pathway. In some embodiments, the one or more modifications that alter expression and/or activity may be an overexpression of one or more genes encoding one or more components of the stress response pathway. In some embodiments, the one or more modifications that alter expression and/or activity may be an increase in the expression of one or more genes encoding one or more components of the oxidative stress response pathway. In some embodiments, the one or more modifications that alter expression and/or activity may be an overexpression of one or more genes encoding one or more components of the oxidative stress response pathway.

In some embodiments, the one or more modifications that alter expression and/or activity may be an elimination or reduction in the expression of one or more genes encoding one or more components of the stress response pathway. In some embodiments, the one or more modifications that alter expression and/or activity may be a deletion of one or more genes, or a portion thereof, encoding one or more components of the stress response pathway. In some embodiments, the one or more modifications that alter expression and/or activity may be a mutation, insertion, and/or substitution in one or more genes encoding one or more components of the stress response pathway. In some embodiments, the one or more modifications that alter expression and/or activity may be an elimination or reduction in the expression of one or more genes encoding one or more components of the oxidative stress response pathway. In some embodiments, the one or more modifications that alter expression and/or activity may be a deletion of one or more genes, or a portion thereof, encoding one or more components of the oxidative stress response pathway. In some embodiments, the one or more modifications that alter expression and/or activity may be a mutation, insertion, and/or substitution in one or more genes encoding one or more components of the oxidative stress response pathway.

In some embodiments, the modification that alters expression and/or activity may be an increase in the expression of one or more genes encoding a yeast activator protein. In some embodiments, the modification that alters expression and/or activity may be an elimination or reduction in the expression of one or more genes encoding a yeast activator protein. In some embodiments, the modification that alters expression and/or activity may be a deletion of one or more genes, or a portion thereof, encoding a yeast activator protein. In some embodiments, the modification that alters expression and/or activity may be a mutation, insertion, and/or substitution in one or more genes encoding a yeast activator protein. In some embodiments, the modification that alters expression and/or activity may be an increase in the expression of one or more genes encoding Yap1, Yap2, Yap3, Yap4, Yap5, Yap6, Yap7, and/or Yap8. In some embodiments, the modification that alters expression and/or activity may be an elimination or reduction in the expression of one or more genes encoding Yap1, Yap2, Yap3, Yap4, Yap5, Yap6, Yap7, and/or Yap8. In some embodiments, the modification that alters expression and/or activity may be a deletion of one or more genes, or a portion thereof, encoding Yap1, Yap2, Yap3, Yap4, Yap5, Yap6, Yap7, and/or Yap8. In some embodiments, the modification that alters expression and/or activity may be a mutation, insertion, and/or substitution in one or more genes encoding Yap1, Yap2, Yap3, Yap4, Yap5, Yap6, Yap7, and/or Yap8.

In some embodiments, the modification that alters expression and/or activity may be an increase in the expression of one or more genes encoding Ybp1, Trx2, Gsh1, Gsh2, Trr1, Gpx2, Tsa1, Ahp1, and/or Glr1. In some embodiments, the modification that alters expression and/or activity may be an elimination or reduction in the expression of one or more genes encoding Ybp1, Trx2, Gsh1, Gsh2, Trr1, Gpx2, Tsa1, Ahp1, and/or Glr1. In some embodiments, the modification that alters expression and/or activity may be a deletion of one or more genes, or a portion thereof, encoding Ybp1, Trx2, Gsh1, Gsh2, Trr1, Gpx2, Tsa1, Ahp1, and/or Glr1. In some embodiments, the modification that alters expression and/or activity may be a mutation, insertion, and/or substitution in one or more genes encoding Ybp1, Trx2, Gsh1, Gsh2, Trr1, Gpx2, Tsa1, Ahp1, and/or Glr1. In some embodiments, the modification that alters expression and/or activity may be an increase in the expression of one or more genes encoding Yap1, Yap2, Yap3, Yap4, Yap5, Yap6, Yap7, Yap8, Ybp1, Trx2, Gsh1, Gsh2, Trr1, Gpx2, Tsa1, Ahp1, and/or Glr1. In some embodiments, the modification that alters expression and/or activity may be an elimination or reduction in the expression of one or more genes encoding Yap1, Yap2, Yap3, Yap4, Yap5, Yap6, Yap7, Yap8, Ybp1, Trx2, Gsh1, Gsh2, Trr1, Gpx2, Tsa1, Ahp1, and/or Glr1. In some embodiments, the modification that alters expression and/or activity may be a deletion of one or more genes, or portion thereof, encoding Yap1, Yap2, Yap3, Yap4, Yap5, Yap6, Yap7, Yap8, Ybp1, Trx2, Gsh1, Gsh2, Trr1, Gpx2, Tsa1, Ahp1, and/or Glr1. In some embodiments, the modification that alters expression and/or activity may be a mutation, insertion, and/or substitution in one or more genes encoding Yap1, Yap2, Yap3, Yap4, Yap5, Yap6, Yap7, Yap8, Ybp1, Trx2, Gsh1, Gsh2, Trr1, Gpx2, Tsa1, Ahp1, and/or Glr1.

In some embodiments, a microorganism may comprise one or more modifications that alter expression and/or activity of one or more components of the stress response pathway. In some embodiments, a microorganism may comprise one or more modifications that alter expression and/or activity of one or more components of the oxidative stress response pathway. In some embodiments, a microorganism may comprise one or more modifications that alter expression and/or activity of one or more yeast activator proteins. In some embodiments, a microorganism may comprise one or more modifications that alter expression and/or activity of Yap1, Yap2, Yap3, Yap4, Yap5, Yap6, Yap7, and/or Yap8. In some embodiments, a microorganism may comprise one or more modifications that alter expression and/or activity of Ybp1, Trx2, Gsh1, Gsh2, Trr1, Gpx2, Tsa1, Ahp1, and/or Glr1. In some embodiments, a microorganism may comprise one or more modifications that alter expression and/or activity of Yap1, Yap2, Yap3, Yap4, Yap5, Yap6, Yap7, Yap8, Ybp1, Trx2, Gsh1, Gsh2, Trr1, Gpx2, Tsa1, Ahp1, and/or Glr1.

In some embodiments, a microorganism may comprise one or more modifications that increase the expression of one or more genes encoding one or more components of a stress response pathway. In some embodiments, a microorganism may comprise one or more modifications that eliminate or reduce the expression of one or more genes encoding one or more components of a stress response pathway. In some embodiments, the stress response pathway may be an oxidative stress response pathway. In some embodiments, a microorganism may comprise one or more modifications that increase the expression of a gene encoding a yeast activator protein. In some embodiments, a microorganism may comprise one or more modifications that eliminate or reduce the expression of a gene encoding a yeast activator protein. In some embodiments, a microorganism may comprise one or more modifications that increase the expression of one or more genes encoding Yap1, Yap2, Yap3, Yap4, Yap5, Yap6, Yap7, and/or Yap8. In some embodiments, a microorganism may comprise one or more modifications that eliminate or reduce the expression of one or more genes encoding Yap1, Yap2, Yap3, Yap4, Yap5, Yap6, Yap7, and/or Yap8. In some embodiments, the one or more modifications may be a deletion of one or more genes described herein, or a portion thereof, a mutation, insertion, and/or substitution in the one or more genes described herein.

In some embodiments, a microorganism may comprise one or more modifications that increase the activity of a yeast activator protein. In some embodiments, a microorganism may comprise one or more modifications that increase the activity of Yap1, Yap2, Yap3, Yap4, Yap5, Yap6, Yap7, and/or Yap8. In some embodiments, a microorganism may comprise one or more modifications that eliminate or reduce the activity of a yeast activator protein. In some embodiments, a microorganism may comprise one or more modifications that eliminate or reduce the activity of Yap1, Yap2, Yap3, Yap4, Yap5, Yap6, Yap7, and/or Yap8.

In some embodiments, a microorganism may comprise one or more modifications that increase the expression of one or more genes encoding Ybp1, Trx2, Gsh1, Gsh2, Trr1, Gpx2, Tsa1, Ahp1, and/or Glr1. In some embodiments, a microorganism may comprise one or more modifications that eliminate or reduce the expression of one or more genes encoding Ybp1, Trx2, Gsh1, Gsh2, Trr1, Gpx2, Tsa1, Ahp1, and/or Glr1. In some embodiments, a microorganism may comprise one or more modifications that increase the expression of one or more genes encoding Yap1, Yap2, Yap3, Yap4, Yap5, Yap6, Yap7, Yap8, Ybp1, Trx2, Gsh1, Gsh2, Trr1, Gpx2, Tsa1, Ahp1, and/or Glr1. In some embodiments, a microorganism may comprise one or more modifications that eliminate or reduce the expression of one or more genes encoding Yap1, Yap2, Yap3, Yap4, Yap5, Yap6, Yap7, Yap8, Ybp1, Trx2, Gsh1, Gsh2, Trr1, Gpx2, Tsa1, Ahp1, and/or Glr1. In some embodiments, the one or more modifications may be a deletion of one or more genes described herein, or a portion thereof, a mutation, insertion, and/or substitution in the one or more genes described herein.

In some embodiments, a microorganism may comprise one or more modifications that increase the activity of Ybp1, Trx2, Gsh1, Gsh2, Trr1, Gpx2, Tsa1, Ahp1, and/or Glr1. In some embodiments, a microorganism may comprise one or more modifications that eliminate or reduce the activity of Ybp1, Trx2, Gsh1, Gsh2, Trr1, Gpx2, Tsa1, Ahp1, and/or Glr1. In some embodiments, a microorganism may comprise one or more modifications that increase the activity of Yap1, Yap2, Yap3, Yap4, Yap5, Yap6, Yap7, Yap8, Ybp1, Trx2, Gsh1, Gsh2, Trr1, Gpx2, Tsa1, Ahp1, and/or Glr1. In some embodiments, a microorganism may comprise one or more modifications that eliminate or reduce the activity of Yap1, Yap2, Yap3, Yap4, Yap5, Yap6, Yap7, Yap8, Ybp1, Trx2, Gsh1, Gsh2, Trr1, Gpx2, Tsa1, Ahp1, and/or Glr1.

In some embodiments, a microorganism may comprise one or more modifications that alter expression and/or activity of one or more components of a stress response pathway and a butanol biosynthetic pathway. In some embodiments, the stress response pathway is a oxidative stress response pathway. In some embodiments, a microorganism may comprise one or more modifications that alter expression and/or activity of one or more yeast activator proteins and a butanol biosynthetic pathway. In some embodiments, a microorganism may comprise one or more modifications that alter expression and/or activity of Yap1, Yap2, Yap3, Yap4, Yap5, Yap6, Yap7, and/or Yap8, and a butanol biosynthetic pathway. In some embodiments, a microorganism may comprise one or more modifications that alter expression and/or activity of Yap1, Yap2, Yap3, Yap4, Yap5, Yap6, Yap7, Yap8, Ybp1, Trx2, Gsh1, Gsh2, Trr1, Gpx2, Tsa1, Ahp1, and/or Glr1, and a butanol biosynthetic pathway. In some embodiments, the butanol biosynthetic pathway may be a 1-butanol biosynthetic pathway, 2-butanol biosynthetic pathway, 2-butanone biosynthetic pathway, or isobutanol biosynthetic pathway.

In some embodiments, a microorganism may comprise one or more modifications that increase the expression of one or more genes encoding one or more components of a stress response pathway and a butanol biosynthetic pathway. In some embodiments, the stress response pathway is a oxidative stress response pathway. In some embodiments, a microorganism may comprise one or more modifications that increase the expression of a gene encoding a yeast activator protein and a butanol biosynthetic pathway. In some embodiments, a microorganism may comprise one or more modifications that increase the expression of one or more genes encoding Yap1, Yap2, Yap3, Yap4, Yap5, Yap6, Yap7, and/or Yap8, and a butanol biosynthetic pathway. In some embodiments, a microorganism may comprise one or more modifications that increase the expression of one or more genes encoding Yap1, Yap2, Yap3, Yap4, Yap5, Yap6, Yap7, Yap8, Ybp1, Trx2, Gsh1, Gsh2, Trr1, Gpx2, Tsa1, Ahp1, and/or Glr1, and a butanol biosynthetic pathway. In some embodiments, the one or more modifications may be a deletion of one or more genes described herein, or a portion thereof, a mutation, insertion, and/or substitution in the one or more genes described herein. In some embodiments, the butanol biosynthetic pathway may be a 1-butanol biosynthetic pathway, 2-butanol biosynthetic pathway, 2-butanone biosynthetic pathway, or isobutanol biosynthetic pathway.

In some embodiments, a microorganism may comprise one or more modifications that increase the activity of a yeast activator protein and a butanol biosynthetic pathway. In some embodiments, a microorganism may comprise one or more modifications that increase the activity of Yap1, Yap2, Yap3, Yap4, Yap5, Yap6, Yap7, and/or Yap8, and a butanol biosynthetic pathway. In some embodiments, a microorganism may comprise one or more modifications that increase the activity of Yap1, Yap2, Yap3, Yap4, Yap5, Yap6, Yap7, Yap8, Ybp1, Trx2, Gsh1, Gsh2, Trr1, Gpx2, Tsa1, Ahp1, and/or Glr1, and a butanol biosynthetic pathway. In some embodiments, the butanol biosynthetic pathway may be a 1-butanol biosynthetic pathway, 2-butanol biosynthetic pathway, 2-butanone biosynthetic pathway, or isobutanol biosynthetic pathway.

In some embodiments, a microorganism may comprise one or more modifications that eliminate or reduce the expression of one or more genes encoding one or more components of a stress response pathway and a butanol biosynthetic pathway. In some embodiments, the stress response pathway is a oxidative stress response pathway. In some embodiments, a microorganism may comprise one or more modifications that eliminate or reduce the expression of a gene encoding a yeast activator protein and a butanol biosynthetic pathway. In some embodiments, a microorganism may comprise one or more modifications that eliminate or reduce the expression of one or more genes encoding Yap1, Yap2, Yap3, Yap4, Yap5, Yap6, Yap7, and/or Yap8, and a butanol biosynthetic pathway. In some embodiments, a microorganism may comprise one or more modifications that eliminate or reduce the expression of one or more genes encoding Yap1, Yap2, Yap3, Yap4, Yap5, Yap6, Yap7, Yap8, Ybp1, Trx2, Gsh1, Gsh2, Trr1, Gpx2, Tsa1, Ahp1, and/or Glr1, and a butanol biosynthetic pathway. In some embodiments, the butanol biosynthetic pathway may be a 1-butanol biosynthetic pathway, 2-butanol biosynthetic pathway, 2-butanone biosynthetic pathway, or isobutanol biosynthetic pathway.

In some embodiments, a microorganism may comprise one or more modifications that eliminate or reduce the activity of a yeast activator protein and a butanol biosynthetic pathway. In some embodiments, a microorganism may comprise one or more modifications that eliminate or reduce the activity of Yap1, Yap2, Yap3, Yap4, Yap5, Yap6, Yap7, and/or Yap8, and a butanol biosynthetic pathway. In some embodiments, a microorganism may comprise one or more modifications that eliminate or reduce the activity of Yap1, Yap2, Yap3, Yap4, Yap5, Yap6, Yap7, Yap8, Ybp1, Trx2, Gsh1, Gsh2, Trr1, Gpx2, Tsa1, Ahp1, and/or Glr1, and a butanol biosynthetic pathway. In some embodiments, the one or more modifications may be a deletion of one or more genes described herein, or a portion thereof, a mutation, insertion, and/or substitution in the one or more genes described herein. In some embodiments, the butanol biosynthetic pathway may be a 1-butanol biosynthetic pathway, 2-butanol biosynthetic pathway, 2-butanone biosynthetic pathway, or isobutanol biosynthetic pathway.

The present invention is directed to compositions comprising a microorganism provided herein. For example, in some embodiments, a composition may comprise a microorganism comprising one or more modifications that alter expression and/or activity of one or more components of a stress response pathway. In some embodiments, the stress response pathway is a oxidative stress response pathway. In some embodiments, a composition may comprise a microorganism comprising one or more modifications that alter expression and/or activity of one or more yeast activator proteins. In some embodiments, a composition may comprise a microorganism comprising one or more modifications that alter expression and/or activity of Yap1, Yap2, Yap3, Yap4, Yap5, Yap6, Yap7, and/or Yap8. In some embodiments, a composition may comprise a microorganism comprising one or more modifications that alter expression and/or activity of Yap1, Yap2, Yap3, Yap4, Yap5, Yap6, Yap7, Yap8, Ybp1, Trx2, Gsh1, Gsh2, Trr1, Gpx2, Tsa1, Ahp1, and/or Glr1.

In some embodiments, a composition may comprise a microorganism comprising one or more modifications that alter expression and/or activity of one or more components of a stress response pathway and a butanol biosynthetic pathway. In some embodiments, the stress response pathway is a oxidative stress response pathway. In some embodiments, a composition may comprise a microorganism comprising one or more modifications that alter expression and/or activity of one or more yeast activator proteins and a butanol biosynthetic pathway. In some embodiments, a composition may comprise a microorganism comprising one or more modifications that alter expression and/or activity of Yap1, Yap2, Yap3, Yap4, Yap5, Yap6, Yap7, and/or Yap8, and a butanol biosynthetic pathway. In some embodiments, a composition may comprise a microorganism comprising one or more modifications that alter expression and/or activity of Yap1, Yap2, Yap3, Yap4, Yap5, Yap6, Yap7, Yap8, Ybp1, Trx2, Gsh1, Gsh2, Trr1, Gpx2, Tsa1, Ahp1, and/or Glr1, and a butanol biosynthetic pathway. In some embodiments, the butanol biosynthetic pathway may be a 1-butanol biosynthetic pathway, 2-butanol biosynthetic pathway, 2-butanone biosynthetic pathway, or isobutanol biosynthetic pathway.

In some embodiments, the microorganism exhibits increased alcohol production as compared to the parent cell. In some embodiments, alcohol production may be determined by measuring, for example: broth titer (grams alcohol produced per liter broth), alcohol yield (grams alcohol produced per gram substrate consumed), volumetric productivity (grams alcohol produced per liter per hour), specific productivity (grams alcohol produced per gram recombinant cell biomass per hour), or combinations thereof.

The present invention is also directed to methods of improving and/or maintaining cell growth and cell viability of a microorganism in a fermentation. In some embodiments, the method comprises obtaining a microorganism (e.g., parent cell) and introducing one or more modifications that alter expression and/or activity of one or more components of a stress response pathway. In some embodiments, the method comprises obtaining a microorganism and introducing one or more modifications that increase the expression of one or more genes encoding one or more components of a stress response pathway. In some embodiments, the method comprises obtaining a microorganism and introducing one or more modifications that eliminate or reduce the expression of one or more genes encoding one or more components of a stress response pathway. In some embodiments, the method comprises obtaining a microorganism and introducing one or more modifications that increase the expression of one or more genes encoding a yeast activator protein. In some embodiments, the method comprises obtaining a microorganism and introducing one or more modifications that eliminate or reduce the expression of one or more genes encoding a yeast activator protein. In some embodiments, the method comprises obtaining a microorganism and introducing one or more modifications that increase the expression of one or more genes encoding Yap1, Yap2, Yap3, Yap4, Yap5, Yap6, Yap7, and/or Yap8. In some embodiments, the method comprises obtaining a microorganism and introducing one or more modifications that eliminate or reduce the expression of one or more genes encoding Yap1, Yap2, Yap3, Yap4, Yap5, Yap6, Yap7, and/or Yap8. In some embodiments, the method comprises obtaining a microorganism and introducing one or more modifications that increase the expression of one or more genes encoding Yap1, Yap2, Yap3, Yap4, Yap5, Yap6, Yap7, Yap8, Ybp1, Trx2, Gsh1, Gsh2, Trr1, Gpx2, Tsa1, Ahp1, and/or Glr1. In some embodiments, the method comprises obtaining a microorganism and introducing one or more modifications that eliminate or reduce the expression of one or more genes encoding Yap1, Yap2, Yap3, Yap4, Yap5, Yap6, Yap7, Yap8, Ybp1, Trx2, Gsh1, Gsh2, Trr1, Gpx2, Tsa1, Ahp1, and/or Glr1. In some embodiments, the one or more modifications may be a deletion of one or more genes described herein, or a portion thereof, a mutation, insertion, and/or substitution in the one or more genes described herein.

In some embodiments, the method comprises obtaining a microorganism and introducing one or more modifications that increase the activity of a yeast activator protein. In some embodiments, the method comprises obtaining a microorganism and introducing one or more modifications that eliminate or reduce the activity of a yeast activator protein. In some embodiments, the method comprises obtaining a microorganism and introducing one or more modifications that increase the activity of Yap1, Yap2, Yap3, Yap4, Yap5, Yap6, Yap7, and/or Yap8. In some embodiments, the method comprises obtaining a microorganism and introducing one or more modifications that eliminate or reduce the activity of Yap1, Yap2, Yap3, Yap4, Yap5, Yap6, Yap7, and/or Yap8. In some embodiments, the method comprises obtaining a microorganism and introducing one or more modifications that increase the activity of Yap1, Yap2, Yap3, Yap4, Yap5, Yap6, Yap7, Yap8, Ybp1, Trx2, Gsh1, Gsh2, Trr1, Gpx2, Tsa1, Ahp1, and/or Glr1. In some embodiments, the method comprises obtaining a microorganism and introducing one or more modifications that eliminate or reduce the activity of Yap1, Yap2, Yap3, Yap4, Yap5, Yap6, Yap7, Yap8, Ybp1, Trx2, Gsh1, Gsh2, Trr1, Gpx2, Tsa1, Ahp1, and/or Glr1.

In some embodiments, the one or more genes encoding one or more components of the stress response pathway may be one or more endogenous genes. In some embodiments, the one or more genes encoding one or more components of the oxidative stress response pathway may be one or more endogenous genes. In some embodiments, the gene encoding one or more yeast activator proteins may be an endogenous gene. In some embodiments, the genes encoding Yap1, Yap2, Yap3, Yap4, Yap5, Yap6, Yap7, Yap8, Ybp1, Trx2, Gsh1, Gsh2, Trr1, Gpx2, Tsa1, Ahp1, and/or Glr1 may be endogenous genes. In some embodiments, the one or more genes encoding one or more components of a butanol biosynthetic pathway may be endogenous genes.

The present invention is also directed to methods of producing an alcohol by a fermentation process. In some embodiments, the method comprises cultivating a microorganism provided herein under conditions whereby the alcohol is produced and recovering the alcohol. In some embodiments, the alcohol may be butanol. In some embodiments, the alcohol may be 1-butanol, 2-butanol, 2-butanone, isobutanol, or tert-butanol.

In some embodiments, the method comprises (a) providing a microorganism as described herein, (b) contacting the microorganism with one or more carbon substrates under conditions whereby an alcohol is produced; and (c) recovering the alcohol. In some embodiments, contacting with the carbon substrate may occur in the presence of an extractant.

Unless defined otherwise, all technical and scientific terms used herein have the same meaning as commonly understood by one of ordinary skill in the art to which this invention belongs. In case of conflict, the present application including the definitions will control. Also, unless otherwise required by context, singular terms shall include pluralities and plural terms shall include the singular. All publications, patents and other references mentioned herein are incorporated by reference in their entireties for all purposes.

In order to further define this invention, the following terms and definitions are herein provided.

As used herein, the terms "comprises," "comprising," "includes," "including," "has," "having," "contains," or "containing," or any other variation thereof, will be understood to imply the inclusion of a stated integer or group of integers but not the exclusion of any other integer or group of integers. For example, a composition, a mixture, a process, a method, an article, or an apparatus that comprises a list of elements is not necessarily limited to only those elements but may include other elements not expressly listed or inherent to such composition, mixture, process, method, article, or apparatus. Further, unless expressly stated to the contrary, "or" refers to an inclusive or and not to an exclusive or. For example, a condition A or B is satisfied by any one of the following: A is true (or present) and B is false (or not present), A is false (or not present) and B is true (or present), and both A and B are true (or present).

As used herein, the term "consists of," or variations such as "consist of" or "consisting of," as used throughout the specification and claims, indicate the inclusion of any recited integer or group of integers, but that no additional integer or group of integers may be added to the specified method, structure, or composition.

As used herein, the term "consists essentially of," or variations such as "consist essentially of," or "consisting essentially of," as used throughout the specification and claims, indicate the inclusion of any recited integer or group of integers, and the optional inclusion of any recited integer or group of integers that do not materially change the basic or novel properties of the specified method, structure, or composition. See M.P.E.P. §2111.03.

Also, the indefinite articles "a" and "an" preceding an element or component of the invention are intended to be nonrestrictive regarding the number of instances, i.e., occurrences of the element or component. Therefore, "a" or "an" should be read to include one or at least one, and the singular word form of the element or component also includes the plural unless the number is obviously meant to be singular.

The term "invention" or "present invention" as used herein is a non-limiting term and is not intended to refer to any single embodiment of the particular invention but encompasses all possible embodiments as described in the application.

As used herein, the term "about" modifying the quantity of an ingredient or reactant of the invention employed refers to variation in the numerical quantity that can occur, for example, through typical measuring and liquid handling procedures used for making concentrates or solutions in the real world; through inadvertent error in these procedures; through differences in the manufacture, source, or purity of the ingredients employed to make the compositions or to carry out the methods; and the like. The term "about" also encompasses amounts that differ due to different equilibrium conditions for a composition resulting from a particular initial mixture. Whether or not modified by the term "about," the claims include equivalents to the quantities. In one embodiment, the term "about" means within 10% of the reported numerical value, preferably within 5% of the reported numerical value.

In some instances, "biomass" as used herein refers to the cell biomass of the fermentation product-producing microorganism, typically provided in units g/L dry cell weight (dcw).

The term "fermentation product" includes any desired product of interest, including lower alkyl alcohols including, but not limited to butanol, lactic acid, 3-hydroxy-propionic acid, acrylic acid, acetic acid, succinic acid, citric acid, fumaric acid, malic acid, itaconic acid, 1,3-propane-diol, ethylene, glycerol, isobutyrate, etc.

The term "alcohol" refers to any alcohol that can be produced by a microorganism in a fermentation process. Alcohol includes any straight-chain or branched, saturated or unsaturated, alcohol molecule with 1-10 carbon atoms. For example, alcohol includes methanol, ethanol, propanol, butanol, pentanol, and hexanol.

The term "butanol" refers to 1-butanol, 2-butanol, 2-butanone, isobutanol, tert-butanol, or mixtures thereof. Isobutanol is also known as 2-methyl-1-propanol.

The term "butanol biosynthetic pathway" as used herein refers to an enzyme pathway to produce 1-butanol, 2-butanol, 2-butanon, or isobutanol. For example, isobutanol biosynthetic pathways are disclosed in U.S. Patent Application Publication No. 2007/0092957, the entire contents of which are herein incorporated by reference.

The term "isobutanol biosynthetic pathway" refers to the enzymatic pathway to produce isobutanol. From time to time "isobutanol biosynthetic pathway" is used synonymously with "isobutanol production pathway."

The term "2-butanone biosynthetic pathway" as used herein refers to an enzyme pathway to produce 2-butanone.

The term "extractant" as used herein refers to one or more organic solvents which may be used to extract a fermentation product such as an alcohol from a fermentation broth.

A "recombinant host cell" is defined as a host cell that has been genetically manipulated to express a biosynthetic production pathway, wherein the host cell either produces a biosynthetic product in greater quantities relative to an unmodified host cell or produces a biosynthetic product that is not ordinarily produced by an unmodified host cell. The term "recombinant host cell" and "recombinant microbial host cell" may be used interchangeably.

The term "fermentable carbon substrate" refers to a carbon source capable of being metabolized by the microorganisms (or recombinant host cells) such as those disclosed herein. Suitable fermentable carbon substrates include, but are not limited to, monosaccharides such as glucose or fructose; disaccharides such as lactose or sucrose; oligosaccharides; polysaccharides such as starch; cellulose, lignocellulose, or hemicellulose; one-carbon substrates; fatty acids; and combinations thereof.

"Fermentation medium" as used herein means a mixture of water, fermentable carbon substrates (e.g., sugars), dissolved solids, optionally microorganisms producing fermentation products, optionally fermentation products, and all other constituents of the material held in the fermentation vessel in which the fermentation product is being made by the reaction of fermentable carbon substrates to fermentation products, water, and carbon dioxide ($CO_2$) by the microorganisms present. From time to time as used herein, the term "fermentation broth" and "fermentation mixture" may be used synonymously with "fermentation medium."

The term "aerobic conditions" as used herein means growth conditions in the presence of oxygen.

The term "microaerobic conditions" as used herein means growth conditions with low levels of dissolved oxygen. For example, the oxygen level may be less than about 1% of air-saturation.

The term "anaerobic conditions" as used herein means growth conditions in the absence of oxygen.

The term "carbon substrate" refers to a carbon source capable of being metabolized by the microorganisms (or recombinant host cells) disclosed herein. Non-limiting examples of carbon substrates are provided herein and include, but are not limited to, monosaccharides, oligosaccharides, polysaccharides, ethanol, lactate, succinate, glycerol, carbon dioxide, methanol, glucose, fructose, sucrose, xylose, arabinose, dextrose, and mixtures thereof.

As used herein, the term "yield" refers to the amount of product per amount of carbon source in g/g. The yield may be exemplified for glucose as the carbon source. It is understood unless otherwise noted that yield is expressed as a percentage of the theoretical yield. In reference to a microorganism or metabolic pathway, "theoretical yield" is defined as the maximum amount of product that can be generated per total amount of substrate as dictated by the stoichiometry of the metabolic pathway used to make the product. It is understood that while in the present disclosure the yield is exemplified for glucose as a carbon source, the invention can be applied to other carbon sources and the yield may vary depending on the carbon source used. One skilled in the art can calculate yields on various carbon sources.

The term "effective titer" as used herein, refers to the total amount of fermentation product (e.g., alcohol) produced by fermentation per liter of fermentation medium. For example, the total amount of fermentation product (e.g., alcohol) may include: (i) the amount of fermentation product (e.g., alcohol) in the fermentation medium; (ii) the amount of fermentation product (e.g., alcohol) recovered from the organic extractant; and (iii) the amount of fermentation product (e.g., alcohol) recovered from the gas phase, if gas stripping is used.

The term "effective rate" as used herein, refers to the total amount of fermentation product (e.g., alcohol) produced by fermentation per liter of fermentation medium per hour of fermentation.

The term "effective yield" as used herein, refers to the amount of fermentation product (e.g., alcohol) produced per unit of fermentable carbon substrate consumed by the microorganism (or recombinant host cell) described herein.

The term "specific productivity" as used herein, refers to the grams (g) of fermentation product (e.g., alcohol) produced per gram (g) of dry cell weight of cells per unit time.

The terms "derivative" and "analog" refer to a polypeptide differing from the enzymes of the invention, but retaining essential properties thereof. The term "derivative" may also refer to host cells differing from the host cells of the invention, but retaining essential properties thereof. Generally, derivatives and analogs are overall closely similar, and, in many regions, identical to the polypeptides of the invention. The terms "derived-from," "derivative," and "analog" when referring to polypeptides of the invention include any polypeptides which retain at least some of the activity of the corresponding native polypeptide (e.g., the activity of its catalytic domain of an enzyme).

Derivatives of polypeptides disclosed herein are polypeptides which may have been altered so as to exhibit features not found on the native polypeptide. Derivatives can be covalently modified by substitution (e.g., amino acid substitution), chemical, enzymatic, or other appropriate means with a moiety other than a naturally occurring amino acid (e.g., a detectable moiety such as an enzyme or radioisotope). Examples of derivatives include fusion proteins, or proteins which are based on a naturally occurring protein sequence, but which have been altered. For example, proteins can be designed by knowledge of a particular amino acid sequence, and/or a particular secondary, tertiary, and/or quaternary structure. Derivatives include proteins that are modified based on the knowledge of a previous sequence, natural or synthetic, which is then optionally modified, often, but not necessarily to confer some improved function. These sequences or proteins, are then said to be derived from a particular protein or amino acid sequence. In some embodiments of the invention, a derivative may retain at least about 50% identity, at least about 60% identity, at least about 70% identity, at least about 80% identity, at least about 90% identity, at least about 95% identity, at least about 97% identity, or at least about 99% identity to the sequence the derivative is derived-from. In some embodiments of the invention, a polypeptide is said to be derived-from a polypeptide naturally found in a particular species if, using molecular genetic techniques, the DNA sequence for part or all of the polypeptide is amplified and placed into a new host cell.

Polypeptides and Polynucleotides for Use in the Invention

As used herein, the term "polypeptide" is intended to encompass a singular polypeptide as well as plural polypeptides, and refers to a molecule composed of monomers (amino acids) linearly linked by amide bonds (also known as peptide bonds). The term "polypeptide" refers to any chain or chains of two or more amino acids, and does not refer to a specific length of the product. Thus, peptides, dipeptides, tripeptides, oligopeptides, protein, amino acid chain, or any other term used to refer to a chain or chains of two or more amino acids, are included within the definition of polypeptide, and the term "polypeptide" may be used instead of, or interchangeably with any of these terms. A polypeptide may be derived from a natural biological source or produced by recombinant technology, but is not necessarily translated from a designated nucleic acid sequence. It may be generated in any manner, including by chemical synthesis. The polypeptides used in this invention comprise full-length polypeptides and fragments thereof.

As used herein, "increased activity" or "increased expression" refers to any measurable increase in a known biological activity or expression of a polypeptide when compared to the same biological activity or expression of the polypeptide prior to the change resulting in the increased activity or expression. Such a change can include a modification of a polypeptide or a polynucleotide encoding a polypeptide as described herein. Increased activity or expression of a polypeptide disclosed herein can be determined by methods well known in the art and disclosed herein.

As used herein, "reduced activity" or "reduced expression" refers to any measurable decrease in a known biological activity or expression of a polypeptide when compared to the same biological activity or expression of the polypeptide prior to the change resulting in the reduced activity or expression. Such a change can include a modification of a polypeptide or a polynucleotide encoding a polypeptide as described herein. A reduced activity or expression of a polypeptide disclosed herein can be determined by methods well known in the art and disclosed herein.

As used herein, "eliminated activity" or "eliminated expression" refers to the abolishment of a known biological activity or expression of a polypeptide when compared to the same biological activity or expression of the polypeptide prior to the change resulting in the eliminated activity or expression. Such a change can include a modification of a polypeptide or a polynucleotide encoding a polypeptide as described herein. An eliminated activity or expression includes a biological activity or expression of a polypeptide that is not measurable when compared to the same biological activity or expression of the polypeptide prior to the change resulting in the eliminated activity or expression. An eliminated activity or expression of a polypeptide disclosed herein can be determined by methods well known in the art and disclosed herein.

By an "isolated" polypeptide or a fragment, variant, or derivative thereof is intended a polypeptide that is not in its natural milieu. No particular level of purification is required. For example, an isolated polypeptide can be removed from its native or natural environment. Recombinantly produced polypeptides and proteins expressed in host cells are considered isolated for the purposes of the invention, as are native or recombinant polypeptides which have been separated, fractionated, or partially or substantially purified by any suitable technique.

A polypeptide of the invention may be of a size of about 10 or more, about 20 or more, about 25 or more, about 50 or more, about 75 or more, about 100 or more, about 200 or more, about 500 or more, about 1,000 or more, or about 2,000 or more amino acids. Polypeptides may have a defined three-dimensional structure, although they do not necessarily have such structure. Polypeptides with a defined three-dimensional structure are referred to as folded, and polypeptides which do not possess a defined three-dimensional structure, but rather can adopt a large number of different conformations, and are referred to as unfolded.

Also included as polypeptides of the present invention are derivatives, analogs, or variants of the foregoing polypeptides, and any combination thereof. The terms "active variant," "active fragment," "active derivative," and "analog" refer to polypeptides of the present invention. Variants of polypeptides of the present invention include polypeptides with altered amino acid sequences due to amino acid substitutions, deletions, and/or insertions. Variants may occur naturally or be non-naturally occurring. Non-naturally occurring variants may be produced using known mutagenesis techniques. Variant polypeptides may comprise conservative or non-conservative amino acid substitutions, deletions, and/or insertions. Derivatives of polypeptides of the present invention, are polypeptides which have been altered so as to exhibit additional features not found on the native polypeptide. Examples include fusion proteins. Variant polypeptides may also be referred to herein as "polypeptide analogs." As used herein, a "derivative" of a polypeptide refers to a subject polypeptide having one or more residues chemically derivatized by reaction of a functional side group. Also included as "derivatives" are those polypeptides which contain one or more naturally occurring amino acid derivatives of the twenty standard amino acids. For example, 4-hydroxyproline may be substituted for proline; 5-hydroxylysine may be substituted for lysine; 3-methylhistidine may be substituted for histidine; homoserine may be substituted for serine; and ornithine may be substituted for lysine.

A "fragment" is a unique portion of a polypeptide used in the invention which is identical in sequence to but shorter in length than the parent full-length sequence. A fragment may comprise up to the entire length of the defined sequence, minus one amino acid residue. For example, a fragment may comprise from about 5 to about 1000 contiguous amino acid residues. A fragment may be at least about 5, about 10, about 15, about 20, about 25, about 30, about 40, about 50, about 60, about 75, about 100, about 150, about 250 or at least about 500 contiguous amino acid residues in length. Fragments may be selected from certain regions of a molecule. For example, a polypeptide fragment may comprise a certain length of contiguous amino acids selected from the first 100 or 200 amino acids of a polypeptide as shown in a certain defined sequence. Clearly these lengths are exemplary, and any length that is supported by the specification, including the Sequence Listing, tables, and figures, may be encompassed by the present embodiments.

Alternatively, recombinant variants encoding these same or similar polypeptides can be synthesized or selected by making use of the redundancy in the genetic code. Various codon substitutions, such as the silent changes which produce various restriction sites, may be introduced to optimize cloning into a plasmid or viral vector or expression in a host cell system.

Amino acid substitutions may be the result of replacing one amino acid with another amino acid having similar structural and/or chemical properties (i.e., conservative amino acid replacements), or they can be the result of replacing one amino acid with an amino acid having different structural and/or chemical properties (i.e., non-conservative amino acid replacements). Conservative amino acid substitutions may be made on the basis of similarity in polarity, charge, solubility, hydrophobicity, hydrophilicity, and/or the amphipathic nature of the residues. For example, nonpolar (hydrophobic) amino acids include alanine, leucine, isoleucine, valine, proline, phenylalanine, tryptophan, and methionine; polar neutral amino acids include glycine, serine, threonine, cysteine, tyrosine, asparagine, and glutamine; positively charged (basic) amino acids include arginine, lysine, and histidine; and negatively charged (acidic) amino acids include aspartic acid and glutamic acid. Alternatively, non-conservative amino acid substitutions can be made by selecting the differences in polarity, charge, solubility, hydrophobicity, hydrophilicity, or the amphipathic nature of any of these amino acids. Insertions or deletions may be in the range of about 1 to about 20 amino acids, or about 1 to about 10 amino acids. The variation allowed may be experimentally determined by systematically making insertions, deletions, or substitutions of amino acids in a polypeptide molecule using recombinant DNA techniques and assaying the resulting recombinant variants for activity.

As used herein, the term "variant" refers to a polypeptide differing from a specifically recited polypeptide of the invention by amino acid insertions, deletions, mutations, and/or substitutions created using, for example, recombinant DNA techniques such as mutagenesis. Guidance in determining which amino acid residues may be replaced, added, or deleted without abolishing activities of interest, may be found by comparing the sequence of the particular polypeptide with that of homologous polypeptides, for example, yeast or bacterial, and minimizing the number of amino acid sequence changes made in regions of high homology (conserved regions) or by replacing amino acids with consensus sequences.

By a polypeptide having an amino acid or polypeptide sequence at least, for example, 95% identical to a query amino acid sequence of the present invention, it is intended that the amino acid sequence of the subject polypeptide is identical to the query sequence except that the subject polypeptide sequence may include up to five amino acid alterations per each 100 amino acids of the query amino acid sequence. In other words, to obtain a polypeptide having an amino acid sequence at least 95% identical to a query amino acid sequence, up to 5% of the amino acid residues in the subject sequence may be inserted, deleted, and/or substituted with another amino acid. These alterations of the reference sequence may occur at the amino or carboxy terminal positions of the reference amino acid sequence or anywhere between those terminal positions, interspersed either individually among residues in the reference sequence or in one or more contiguous groups within the references sequence.

As a practical matter, whether any particular polypeptide is at least about 80%, about 85%, about 90%, about 95%, about 96%, about 97%, about 98%, or about 99% identical to a reference polypeptide can be determined conventionally using known computer programs. For example, a method for determining the best overall match between a query sequence (e.g., a sequence of the present invention) and a subject sequence, also referred to as a global sequence alignment, can be determined using the FASTDB computer program based on the algorithm of Brutlag, et al. (Comp. Appl. Biosci. 6:237-245, 1990). In a sequence alignment, the query and subject sequences are either both nucleotide sequences or both amino acid sequences. The result of the global sequence alignment is in percent identity. Parameters that may be used in a FASTDB amino acid alignment are: Matrix=PAM 0, k-tuple=2, Mismatch Penalty=1, Joining Penalty=20, Randomization Group Length=0, Cutoff Score=1, Window Size=sequence length, Gap Penalty=5, Gap Size Penalty-0.05, Window Size=500 or the length of the subject amino acid sequence, whichever is shorter.

If the subject sequence is shorter than the query sequence due to N- or C-terminal deletions, not because of internal deletions, a manual correction must be made to the results. This is because the FASTDB program does not account for N- and C-terminal truncations of the subject sequence when calculating global percent identity. For subject sequences truncated at the N- and C-termini, relative to the query sequence, the percent identity is corrected by calculating the number of residues of the query sequence that are N- and C-terminal of the subject sequence, which are not matched/ aligned with a corresponding subject residue, as a percent of the total bases of the query sequence. Whether a residue is matched/aligned is determined by results of the FASTDB sequence alignment. This percentage is then subtracted from the percent identity, calculated by the above FASTDB program using the specified parameters, to arrive at a final percent identity score. This final percent identity score is what is used for the purposes of the present invention. Only residues to the N- and C-termini of the subject sequence, which are not matched/aligned with the query sequence, are considered for the purposes of manually adjusting the percent identity score. That is, only query residue positions outside the farthest N- and C-terminal residues of the subject sequence.

For example, a 90 amino acid residue subject sequence is aligned with a 100 residue query sequence to determine percent identity. The deletion occurs at the N-terminus of the subject sequence and therefore, the FASTDB alignment does not show a matching/alignment of the first 10 residues at the N-terminus. The 10 unpaired residues represent 10% of the sequence (number of residues at the N- and C-termini not matched/total number of residues in the query sequence) so 10% is subtracted from the percent identity score calculated by the FASTDB program. If the remaining 90 residues were perfectly matched the final percent identity would be 90%. In another example, a 90 residue subject sequence is compared with a 100 residue query sequence. This time the deletions are internal deletions so there are no residues at the N- or C-termini of the subject sequence which are not matched/aligned with the query. In this case, the percent identity calculated by FASTDB is not manually corrected. Once again, only residue positions outside the N- and C-terminal ends of the subject sequence, as displayed in the FASTDB alignment, which are not matched/aligned with the query sequence are manually corrected for. No other manual corrections are to be made for the purposes of the present invention.

Polypeptides suitable for use in the present invention and fragments thereof are encoded by polynucleotides. The term "polynucleotide" is intended to encompass a singular nucleic acid as well as plural nucleic acids, and refers to an isolated nucleic acid molecule or construct, for example, messenger RNA (mRNA), virally-derived RNA, or plasmid DNA (pDNA). A polynucleotide may comprise a conventional phosphodiester bond or a non-conventional bond (e.g., an amide bond, such as found in peptide nucleic acids (PNA)). A polynucleotide may contain the nucleotide sequence of the full-length cDNA sequence, or a fragment thereof, including the untranslated 5' and 3' sequences and the coding sequences. The polynucleotide may be composed of any polyribonucleotide or polydeoxyribonucleotide, which may be unmodified RNA or DNA or modified RNA or DNA. For example, polynucleotides may be composed of single- and double-stranded DNA, DNA that is a mixture of single- and double-stranded regions, single- and double-stranded RNA, and RNA that is mixture of single- and double-stranded regions, hybrid molecules comprising DNA and RNA that may be single-stranded or, more typically, double-stranded or a mixture of single- and double-stranded regions. Polynucleotide embraces chemically, enzymatically, or metabolically modified forms.

The term "nucleic acid" refers to any one or more nucleic acid segments, for example, DNA or RNA fragments, present in a polynucleotide. Polynucleotides according to the present invention further include such molecules produced synthetically. Polynucleotides of the invention may be native to the host cell or heterologous. In addition, a polynucleotide or a nucleic acid may be or may include a regulatory element such as a promoter, ribosome binding site, or a transcription terminator.

In some embodiments, the polynucleotide or nucleic acid is DNA. In the case of DNA, a polynucleotide comprising a nucleic acid, which encodes a polypeptide normally may include a promoter and/or other transcription or translation control elements operably associated with one or more coding regions. An operable association is when a coding region for a gene product, for example, a polypeptide, is associated with one or more regulatory sequences in such a way as to place expression of the gene product under the influence or control of the regulatory sequence(s). Two DNA fragments (such as a polypeptide coding region and a promoter associated therewith) are operably associated if induction of promoter function results in the transcription of mRNA encoding the desired gene product and if the nature of the linkage between the two DNA fragments does not interfere with the ability of the expression regulatory sequences to direct the expression of the gene product or interfere with the ability of the DNA template to be transcribed. Thus, a promoter region would be operably associated with a nucleic acid encoding a polypeptide if the promoter was capable of effecting transcription of that nucleic acid. Other transcription control elements, besides a promoter, for example enhancers, operators, repressors, and transcription termination signals, may be operably associated with the polynucleotide. Suitable promoters and other transcription control regions are disclosed herein.

A polynucleotide sequence may be referred to as isolated, in which it has been removed from its native environment. For example, a heterologous polynucleotide encoding a polypeptide or polypeptide fragment having enzymatic activity (e.g., the ability to convert a substrate to xylulose) contained in a vector is considered isolated for the purposes of the present invention. Further examples of an isolated polynucleotide include recombinant polynucleotides maintained in heterologous host cells or purified (partially or substantially) polynucleotides in solution. Isolated polynucleotides or nucleic acids according to the present invention further include such molecules produced synthetically. An isolated polynucleotide fragment in the form of a polymer of DNA may be comprised of one or more segments of cDNA, genomic DNA, or synthetic DNA.

The term "gene" refers to a nucleic acid fragment that is capable of being expressed as a specific protein, optionally including regulatory sequences preceding (5' non-coding sequences) and following (3' non-coding sequences) the coding sequence. In some instances, the term "gene" and "polynucleotide" may be used interchangeably.

As used herein, a "coding region" or "ORF" is a portion of nucleic acid which consists of codons translated into amino acids. Although a stop codon (e.g., TAG, TGA, or TAA) is not translated into an amino acid, it may be considered to be part of a coding region, if present, but any flanking sequences, for example, promoters, ribosome binding sites, transcriptional terminators, introns, 5' and 3' non-translated regions, and the like, are not part of a coding region. Suitable regulatory sequences refer to nucleotide sequences located upstream (5' non-coding sequences), within, or downstream (3' non-coding sequences) of a coding sequence that influence the transcription, RNA processing or stability, or translation of the associated coding sequence. Regulatory sequences may include promoters, translation leader sequences, introns, polyadenylation recognition sequences, RNA processing sites, effector binding sites, and stem-loop structures.

A variety of translation control elements are known to those of ordinary skill in the art. These include, but are not limited to, ribosome binding sites, translation initiation and termination codons, and elements derived from viral systems (particularly an internal ribosome entry site, or IRES). In some embodiments, a polynucleotide of the present invention is RNA, for example, in the form of messenger RNA (mRNA). RNA of the present invention may be single-stranded or double-stranded.

Polynucleotide and nucleic acid coding regions of the present invention may be associated with additional coding regions which encode secretory or signal peptides, which direct the secretion of a polypeptide encoded by a polynucleotide of the present invention.

As used herein, the term "transformation" refers to the transfer of a nucleic acid fragment into the genome of a host organism, resulting in genetically stable inheritance. Host organisms containing the transformed nucleic acid fragments are referred to as recombinant or transformed organisms.

The term "expression," as used herein, refers to the transcription and stable accumulation of sense (mRNA) or antisense RNA derived from the nucleic acid fragment of the invention. Expression may also refer to translation of mRNA into a polypeptide.

The term "overexpression," as used herein, refers to an increase in the level of nucleic acid or protein in a host cell. Thus, overexpression can result from increasing the level of transcription or translation of an endogenous sequence in a host cell or can result from the introduction of a heterologous sequence into a host cell. Overexpression can also result from increasing the stability of a nucleic acid or protein sequence.

The terms "plasmid," "vector," and "cassette" refer to an extra chromosomal element often carrying genes which are not part of the central metabolism of the cell, and usually in the form of circular double-stranded DNA fragments. Such elements may be autonomously replicating sequences, genome integrating sequences, phage or nucleotide sequences, linear or circular, of a single- or double-stranded DNA or RNA, derived from any source, in which a number of nucleotide sequences have been joined or recombined into a unique construction which is capable of introducing a promoter fragment and DNA sequence for a selected gene product along with appropriate 3' untranslated sequence into a cell. Transformation cassette refers to a specific vector containing a foreign gene and having elements in addition to the foreign gene that facilitates transformation of a particular host cell. Expression cassette refers to a specific vector containing a foreign gene and having elements in addition to the foreign gene that allow for enhanced expression of that gene in a foreign host.

The term "artificial" refers to a synthetic, or non-host cell derived composition, for example, a chemically-synthesized oligonucleotide.

As used herein, "native" refers to the form of a polynucleotide, gene, or polypeptide as found in nature with its own regulatory sequences, if present.

The term "endogenous," when used in reference to a polynucleotide, a gene, or a polypeptide refers to a native polynucleotide or gene in its natural location in the genome of an organism, or for a native polypeptide, is transcribed and translated from this location in the genome.

The term "heterologous" when used in reference to a polynucleotide, a gene, or a polypeptide refers to a polynucleotide, gene, or polypeptide not normally found in the host organism. Heterologous polynucleotide includes a native coding region, or portion thereof, that is reintroduced into the source organism in a form that is different from the corresponding native polynucleotide. Heterologous gene includes a native coding region, or portion thereof, that is reintroduced into the source organism in a form that is different from the corresponding native gene, for example, not in its natural location in the organism's genome. For example, a heterologous gene may include a native coding region that is a portion of a chimeric gene including non-native regulatory regions that is reintroduced into the native host. A transgene is a gene that has been introduced into the genome by a transformation procedure. Heterologous polypeptide includes a native polypeptide that is reintroduced into the source organism in a form that is different from the corresponding native polypeptide. The heterologous polynucleotide or gene may be introduced into the host organism by, for example, gene transfer.

As used herein, the term "modification" refers to a change in a polynucleotide disclosed herein that results in altered activity of a polypeptide encoded by the polynucleotide, as well as a change in a polypeptide disclosed herein that results in altered activity of the polypeptide. Such changes may be made by methods well known in the art, including, but not limited to, deleting, mutating (e.g., spontaneous mutagenesis, random mutagenesis, mutagenesis caused by mutator genes, or transposon mutagenesis), substituting, inserting, overexpressing, altering the cellular location, altering the state of the polynucleotide or polypeptide (e.g., methylation, phosphorylation or ubiquitination), removing a cofactor, chemical modification, covalent modification, irradiation with UV or X-rays, homologous recombination, mitotic recombination, promoter replacement methods, and/or combinations thereof. Guidance in determining which nucleotides or amino acid residues can be modified, may be found by comparing the sequence of the particular polynucleotide or polypeptide with that of homologous polynucleotides or polypeptides, for example, yeast or bacterial, and maximizing the number of modifications made in regions of high homology (conserved regions) or consensus sequences.

As used herein, the term "variant" refers to a polynucleotide differing from a specifically recited polynucleotide of the invention by nucleotide insertions, deletions, mutations, and substitutions, created using, for example, recombinant DNA techniques, such as mutagenesis. Recombinant polynucleotide variants encoding same or similar polypeptides may be synthesized or selected by making use of the redundancy in the genetic code. Various codon substitutions, such as silent changes which produce various restriction sites, may be introduced to optimize cloning into a plasmid or viral vector for expression. Mutations in the polynucleotide sequence may be reflected in the polypeptide or domains of other peptides added to the polypeptide to modify the properties of any part of the polypeptide.

The term "recombinant genetic expression element" refers to a nucleic acid fragment that expresses one or more specific proteins, including regulatory sequences preceding (5' non-coding sequences) and following (3' termination sequences) coding sequences for the proteins. A chimeric gene is a recombinant genetic expression element. The coding regions of an operon may form a recombinant genetic expression element, along with an operably linked promoter and termination region.

"Regulatory sequences" refers to nucleotide sequences located upstream (5' non-coding sequences), within, or downstream (3' non-coding sequences) of a coding sequence, and which influence the transcription, RNA processing or stability, or translation of the associated coding sequence. Regulatory sequences may include promoters, enhancers, operators, repressors, transcription termination signals, translation leader sequences, introns, polyadenylation recognition sequences, RNA processing site, effector binding site, and stem-loop structure.

The term "promoter" refers to a nucleic acid sequence capable of controlling the expression of a coding sequence or functional RNA. In general, a coding sequence is located 3' to a promoter sequence. Promoters may be derived in their entirety from a native gene, or be composed of different elements derived from different promoters found in nature, or even comprise synthetic nucleic acid segments. It is understood by those skilled in the art that different promoters may direct the expression of a gene in different tissues or cell types, or at different stages of development, or in response to different environmental or physiological conditions. Promoters which cause a gene to be expressed in most cell types at most times are commonly referred to as constitutive promoters. Inducible promoters, on the other hand, cause a gene to be expressed when the promoter is induced or turned on by a promoter-specific signal or molecule. It is further recognized that since in most cases the exact boundaries of regulatory sequences have not been completely defined, DNA fragments of different lengths may have identical promoter activity. For example, it will be understood that FBA1 promoter may be used to refer to a fragment derived from the promoter region of the FBA1 gene.

The term "terminator" as used herein refers to DNA sequences located downstream of a coding sequence. This includes polyadenylation recognition sequences and other sequences encoding regulatory signals capable of affecting mRNA processing or gene expression. The polyadenylation signal is usually characterized by affecting the addition of polyadenylic acid tracts to the 3' end of the mRNA precursor. The 3' region can influence the transcription, RNA processing or stability, or translation of the associated coding sequence. It is recognized that since in most cases the exact boundaries of regulatory sequences have not been completely defined, DNA fragments of different lengths may have identical terminator activity. For example, it will be understood that "CYC1 terminator" may be used to refer to a fragment derived from the terminator region of the CYC1 gene.

The term "operably linked" refers to the association of nucleic acid sequences on a single nucleic acid fragment so that the function of one is affected by the other. For example, a promoter is operably linked with a coding sequence when it is capable of effecting the expression of that coding sequence (i.e., that the coding sequence is under the transcriptional control of the promoter). Coding sequences can be operably linked to regulatory sequences in sense or antisense orientation.

As used herein, the term "transformation" refers to the transfer of a nucleic acid fragment into the genome of a host microorganism, resulting in genetically stable inheritance. Host microorganisms containing the transformed nucleic acid fragments are referred to as "transgenic," "recombinant," or "transformed" microorganisms.

The term "codon-optimized," as it refers to genes or coding regions of nucleic acid molecules for transformation of various hosts, refers to the alteration of codons in the gene or coding regions of the nucleic acid molecules to reflect the typical codon usage of the host organism without altering the polypeptide encoded by the DNA. Such optimization includes replacing at least one, more than one, or a significant number of codons with one or more codons that are more frequently used in the genes of that organism.

Deviations in the nucleotide sequence that comprise the codons encoding the amino acids of any polypeptide chain allow for variations in the sequence coding for the gene. Since each codon consists of three nucleotides, and the nucleotides comprising DNA are restricted to four specific bases, there are 64 possible combinations of nucleotides, 61 of which encode amino acids (the remaining three codons encode signals ending translation). The genetic code which shows which codons encode which amino acids is reproduced herein as Table 2. As a result, many amino acids are designated by more than one codon. For example, the amino acids alanine and proline are coded for by four triplets, serine and arginine by six, whereas tryptophan and methionine are coded by just one triplet. This degeneracy allows for DNA base composition to vary over a wide range without altering the amino acid sequence of the proteins encoded by the DNA.

TABLE 2

The Standard Genetic Code

| | T | C | A | G |
|---|---|---|---|---|
| T | TTT Phe (F) | TCT Ser (S) | TAT Tyr (Y) | TGT Cys (C) |
| | TTC " | TCC " | TAC " | TGC " |
| | TTA Leu (L) | TCA " | TAA Ter | TGA Ter |
| | TTG " | TCG " | TAG Ter | TGG Trp (W) |
| C | CTT Leu (L) | CCT Pro (P) | CAT His (H) | CGT Arg (R) |
| | CTC " | CCC " | CAC " | CGC " |
| | CTA " | CCA " | CAA Gln (Q) | CGA " |
| | CTG " | CCG " | CAG " | CGG " |
| A | ATT Ile (I) | ACT Thr (T) | AAT Asn (N) | AGT Ser (S) |
| | ATC " | ACC " | AAC " | AGC " |
| | ATA " | ACA " | AAA Lys (K) | AGA Arg (R) |
| | ATG Met (M) | ACG " | AAG " | AGG " |
| G | GTT Val (V) | GCT Ala (A) | GAT Asp (D) | GGT Gly (G) |
| | GTC " | GCC " | GAC " | GGC " |
| | GTA " | GCA " | GAA Glu (E) | GGA " |
| | GTG " | GCG " | GAAG " | GGG " |

Many organisms display a bias for use of particular codons to code for insertion of a particular amino acid in a growing peptide chain. Codon preference or codon bias, differences in codon usage between organisms, is afforded by degeneracy of the genetic code, and is well documented among many organisms. Codon bias often correlates with the efficiency of translation of messenger RNA (mRNA), which is in turn believed to be dependent on, inter alia, the properties of the codons being translated and the availability of particular transfer RNA (tRNA) molecules. The predominance of selected tRNAs in a cell is generally a reflection of the codons used most frequently in peptide synthesis. Accordingly, genes may be tailored for optimal gene expression in a given organism based on codon optimization.

Given the large number of gene sequences available for a wide variety of animal, plant, and microbial species, it is possible to calculate the relative frequencies of codon usage. Codon usage tables are readily available, for example, at the "Codon Usage Database" available at http://www.kazusa.or.jp/codon/ (visited Mar. 20, 2008), and these tables may be adapted in a number of ways (see, e.g., Nakamura, et al., Nucl. Acids Res. 28:292, 2000). Codon usage tables for yeast, calculated from GenBank Release 128.0 [15 Feb. 2002], are reproduced below as Table 3. This table uses mRNA nomenclature, and so instead of thymine (T) which is found in DNA, the table uses uracil (U) which is found in RNA. The table has been adapted so that frequencies are calculated for each amino acid, rather than for all 64 codons.

TABLE 3

Codon Usage Table for *Saccharomyces cerevisiae* Genes

| Amino Acid | Codon | Number | Frequency per thousand |
|---|---|---|---|
| Phe | UUU | 170666 | 26.1 |
| Phe | UUC | 120510 | 18.4 |
| Leu | UUA | 170884 | 26.2 |
| Leu | UUG | 177573 | 27.2 |
| Leu | CUU | 80076 | 12.3 |
| Leu | CUC | 35545 | 5.4 |
| Leu | CUA | 87619 | 13.4 |
| Leu | CUG | 68494 | 10.5 |
| Ile | AUU | 196893 | 30.1 |
| Ile | AUC | 112176 | 17.2 |
| Ile | AUA | 116254 | 17.8 |
| Met | AUG | 136805 | 20.9 |
| Val | GUU | 144243 | 22.1 |
| Val | GUC | 76947 | 11.8 |
| Val | GUA | 76927 | 11.8 |
| Val | GUG | 70337 | 10.8 |
| Ser | UCU | 153557 | 23.5 |
| Ser | UCC | 92923 | 14.2 |
| Ser | UCA | 122028 | 18.7 |
| Ser | UCG | 55951 | 8.6 |
| Ser | AGU | 92466 | 14.2 |
| Ser | AGC | 63726 | 9.8 |
| Pro | CCU | 88263 | 13.5 |
| Pro | CCC | 44309 | 6.8 |
| Pro | CCA | 119641 | 18.3 |
| Pro | CCG | 34597 | 5.3 |
| Thr | ACU | 132522 | 20.3 |
| Thr | ACC | 83207 | 12.7 |
| Thr | ACA | 116084 | 17.8 |
| Thr | ACG | 52045 | 8.0 |
| Ala | GCU | 138358 | 21.2 |
| Ala | GCC | 82357 | 12.6 |
| Ala | GCA | 105910 | 16.2 |
| Ala | GCG | 40358 | 6.2 |
| Tyr | UAU | 122728 | 18.8 |
| Tyr | UAC | 96596 | 14.8 |
| His | CAU | 89007 | 13.6 |
| His | CAC | 50785 | 7.8 |
| Gln | CAA | 178251 | 27.3 |
| Gln | CAG | 79121 | 12.1 |
| Asn | AAU | 233124 | 35.7 |
| Asn | AAC | 162199 | 24.8 |
| Lys | AAA | 273618 | 41.9 |
| Lys | AAG | 201361 | 30.8 |
| Asp | GAU | 245641 | 37.6 |
| Asp | GAC | 132048 | 20.2 |
| Glu | GAA | 297944 | 45.6 |
| Glu | GAG | 125717 | 19.2 |
| Cys | UGU | 52903 | 8.1 |
| Cys | UGC | 31095 | 4.8 |
| Trp | UGG | 67789 | 10.4 |
| Arg | CGU | 41791 | 6.4 |
| Arg | CGC | 16993 | 2.6 |
| Arg | CGA | 19562 | 3.0 |
| Arg | CGG | 11351 | 1.7 |
| Arg | AGA | 139081 | 21.3 |
| Arg | AGG | 60289 | 9.2 |
| Gly | GGU | 156109 | 23.9 |
| Gly | GGC | 63903 | 9.8 |
| Gly | GGA | 71216 | 10.9 |
| Gly | GGG | 39359 | 6.0 |
| Stop | UAA | 6913 | 1.1 |
| Stop | UAG | 3312 | 0.5 |
| Stop | UGA | 4447 | 0.7 |

By utilizing this or similar tables, one of ordinary skill in the art may apply the frequencies to any given polypeptide sequence, and produce a nucleic acid fragment of a codon-optimized coding region which encodes the polypeptide, but which uses codons optimal for a given species.

Randomly assigning codons at an optimized frequency to encode a given polypeptide sequence may be done manually by calculating codon frequencies for each amino acid, and then assigning the codons to the polypeptide sequence randomly. Additionally, various algorithms and computer software programs are readily available to those of ordinary skill in the art, for example, the EditSeq function in the Lasergene Package, available from DNAstar, Inc., Madison, Wis., the backtranslation function in the VectorNTI Suite, available from InforMax, Inc., Bethesda, Md., and the backtranslate function in the GCG-Wisconsin Package, available from Accelrys, Inc., San Diego, Calif. In addition, various resources are publicly available to codon-optimize coding region sequences, for example, the backtranslation function at http://www.entelechon.com/bioinformatics/backtranslation.php?lang=eng (visited Apr. 15, 2008) and the backtranseq function available at http://bioinfo.pbi.nrc.ca:8090/EMBOSS/index.html (visited Jul. 9, 2002). Constructing a rudimentary algorithm to assign codons based on a given frequency can also easily be accomplished with basic mathematical functions by one of ordinary skill in the art. Codon-optimized coding regions may be designed by various methods known to those skilled in the art including software packages such as Synthetic Gene Designer (http://phenotype.biosci.umbc.edu/codon/sgd/index.php).

A polynucleotide or nucleic acid fragment is hybridizable to another nucleic acid fragment, such as a cDNA, genomic DNA, or RNA molecule, when a single-stranded form of the nucleic acid fragment can anneal to the other nucleic acid fragment under the appropriate conditions of temperature and solution ionic strength. Hybridization and washing conditions are well known and exemplified in Sambrook, J., Fritsch, E. F. and Maniatis, T. *Molecular Cloning: A Laboratory Manual*, 2$^{nd}$ ed., Cold Spring Harbor Laboratory: Cold Spring Harbor, N.Y. (1989), particularly Chapter 11 and Table 11.1 therein. The conditions of temperature and ionic strength determine the stringency of the hybridization. Stringency conditions may be adjusted to screen for moderately similar fragments (such as homologous sequences from distantly related organisms), to highly similar fragments (such as genes that duplicate functional enzymes from closely related organisms). Post-hybridization washes determine stringency conditions. One set of preferred conditions uses a series of washes starting with 6×SSC, 0.5% SDS at room temperature for 15 min, then repeated with 2×SSC, 0.5% SDS at 45° C. for 30 min, and then repeated twice with 0.2×SSC, 0.5% SDS at 50° C. for 30 min. A more preferred set of stringent conditions uses higher temperatures in which the washes are identical to those above except for the temperature of the final two 30 min washes in 0.2×SSC, 0.5% SDS was increased to 60° C. Another preferred set of highly stringent conditions uses two final washes in 0.1× SSC, 0.1% SDS at 65° C. An additional set of stringent conditions include hybridization at 0.1×SSC, 0.1% SDS, 65° C. and washes with 2×SSC, 0.1% SDS followed by 0.1× SSC, 0.1% SDS.

Hybridization requires that the two nucleic acids contain complementary sequences, although depending on the stringency of the hybridization, mismatches between bases are possible. The appropriate stringency for hybridizing nucleic acids depends on the length of the nucleic acids and the degree of complementation, variables well known in the art. The greater the degree of similarity or homology between two nucleotide sequences, the greater the value of Tm for hybrids of nucleic acids having those sequences. The relative stability (corresponding to higher Tm) of nucleic acid hybridizations decreases in the following order: RNA:RNA, DNA:RNA, DNA:DNA. For hybrids of greater than 100 nucleotides in length, equations for calculating Tm have been derived (see, e.g., Sambrook, et al., supra, 9.50-9.51). For hybridizations with shorter nucleic acids (e.g., oligonucleotides), the position of mismatches becomes more important, and the length of the oligonucleotide determines its specificity (see, e.g., Sambrook, et al., supra, 11.7-11.8). In some embodiments, the length for a hybridizable nucleic acid is at least about 10 nucleotides, at least about 15 nucleotides, at least about 20 nucleotides, or at least about 30 nucleotides. Furthermore, the skilled artisan will recognize that the temperature and wash solution salt concentration may be adjusted as necessary according to factors such as length of the probe.

A "substantial portion" of an amino acid or nucleotide sequence is that portion comprising enough of the amino acid sequence of a polypeptide or the nucleotide sequence of a gene to putatively identify that polypeptide or gene, either by manual evaluation of the sequence by one skilled in the art, or by computer-automated sequence comparison and identification using algorithms such as BLAST (Altschul, et al., J. Mol. Biol. 215:403-410, 1993). In general, a sequence of ten or more contiguous amino acids or thirty or more nucleotides is necessary in order to putatively identify a polypeptide or nucleic acid sequence as homologous to a known protein or gene. Moreover, with respect to nucleotide sequences, gene specific oligonucleotide probes comprising 20-30 contiguous nucleotides may be used in sequence-dependent methods of gene identification (e.g., Southern hybridization) and isolation (e.g., in situ hybridization of bacterial colonies or bacteriophage plaques). In addition, short oligonucleotides of 12-15 bases may be used as amplification primers in PCR in order to obtain a particular nucleic acid fragment comprising the primers. Accordingly, a substantial portion of a nucleotide sequence comprises enough of the sequence to specifically identify and/or isolate a nucleic acid fragment comprising the sequence. The instant specification teaches the complete amino acid and nucleotide sequence encoding particular proteins. The skilled artisan, having the benefit of the sequences as reported herein, may now use all or a substantial portion of the disclosed sequences for purposes known to those skilled in this art. Accordingly, the instant invention comprises the complete sequences as provided herein, as well as substantial portions of those sequences as defined above.

The term "complementary" is used to describe the relationship between nucleotide bases that are capable of hybridizing to one another. For example, with respect to DNA, adenosine is complementary to thymine and cytosine is complementary to guanine.

The term "percent identity" as known in the art, is a relationship between two or more polypeptide sequences or two or more polynucleotide sequences, as determined by comparing the sequences. In the art, identity also means the degree of sequence relatedness between polypeptide or polynucleotide sequences, as the case may be, as determined by the match between strings of such sequences. Identity and similarity may be readily calculated by known methods, including but not limited to those disclosed in: 1) *Computational Molecular Biology* (Lesk, A. M., Ed.) Oxford University: NY (1988); 2) *Biocomputing: Informatics and Genome Projects* (Smith, D. W., Ed.) Academic: NY (1993); 3) *Computer Analysis of Sequence Data, Part I* (Griffin, A. M., and Griffin, H. G., Eds.) Humania: NJ (1994); 4) *Sequence Analysis in Molecular Biology* (von Heinje, G., Ed.) Academic (1987); and 5) *Sequence Analysis Primer* (Gribskov, M. and Devereux, J., Eds.) Stockton: NY (1991).

Preferred methods to determine identity are designed to give the best match between the sequences tested. Methods to determine identity and similarity are codified in publicly available computer programs. Sequence alignments and percent identity calculations may be performed using the MegAlign™ program of the LASERGENE bioinformatics computing suite (DNASTAR Inc., Madison, Wis.). Multiple alignment of the sequences may be performed using the Clustal method of alignment which encompasses several varieties of the algorithm including the Clustal V method of alignment corresponding to the alignment method labeled Clustal V (disclosed by Higgins and Sharp, CABIOS. 5:151-153, 1989; Higgins, et al., Comput. Appl. Biosci. 8:189-191, 1992) and found in the MegAlign™ program of the LASER-GENE bioinformatics computing suite (DNASTAR Inc.). For multiple alignments, the default values correspond to GAP PENALTY=10 and GAP LENGTH PENALTY=10. Default parameters for pairwise alignments and calculation of percent identity of protein sequences using the Clustal method are KTUPLE=1, GAP PENALTY=3, WINDOW=5 and DIAGONALS SAVED=5. For nucleic acids, these parameters are KTUPLE=2, GAP PENALTY=5, WINDOW=4 and DIAGONALS SAVED=4. After alignment of the sequences using the Clustal V program, it is possible to obtain a percent identity by viewing the sequence distances table in the same program. Additionally the Clustal W method of alignment is available and corresponds to the alignment method labeled Clustal W (described by Higgins and Sharp, CABIOS. 5:151-153, 1989; Higgins, et al., Comput. Appl. Biosci. 8:189-191, 1992) and found in the MegAlign™ v6.1 program of the LASERGENE bioinformatics computing suite (DNASTAR Inc.). Default parameters for multiple alignment (GAP PENALTY=10, GAP LENGTH PENALTY=0.2, Delay Divergen Seqs (%)=30, DNA Transition Weight=0.5, Protein Weight Matrix=Gonnet Series, DNA Weight Matrix=IUB). After alignment of the sequences using the Clustal W program, it is possible to obtain a percent identity by viewing the sequence distances table in the same program.

The term "sequence analysis software" refers to any computer algorithm or software program that is useful for the analysis of nucleotide or amino acid sequences. Sequence analysis software may be commercially available or independently developed. Typical sequence analysis software includes, but is not limited to: 1) the GCG suite of programs (Wisconsin Package Version 9.0, Genetics Computer Group (GCG), Madison, Wis.); 2) BLASTP, BLASTN, BLASTX (Altschul, et al., J. Mol. Biol. 215:403-410, 1990); 3) DNASTAR (DNASTAR, Inc., Madison, Wis.); 4) Sequencher (Gene Codes Corporation, Ann Arbor, Mich.); and 5) the FASTA program incorporating the Smith-Waterman algorithm (W. R. Pearson, *Comput. Methods Genome Res.*, [Proc. Int. Symp.] 1994, Meeting Date 1992, 111-20, Editor(s): Suhai, Sandor. Plenum: New York, N.Y.). Within the context of this application, it will be understood that where sequence analysis software is used for analysis, that the results of the analysis may be based on the default values of the program referenced, unless otherwise specified. As used herein "default values" mean any set of values or parameters that originally load with the software when first initialized.

By a nucleic acid or polynucleotide having a nucleotide sequence at least, for example, 95% identical to a reference nucleotide sequence of the present invention, it is intended that the nucleotide sequence of the polynucleotide is identical to the reference sequence except that the polynucleotide sequence may include up to five point mutations per each 100 nucleotides of the reference nucleotide sequence. In other words, to obtain a polynucleotide having a nucleotide sequence at least 95% identical to a reference nucleotide sequence, up to 5% of the nucleotides in the reference sequence may be deleted or substituted with another nucleotide, or a number of nucleotides up to 5% of the total nucleotides in the reference sequence may be inserted into the reference sequence.

As a practical matter, whether any particular nucleic acid molecule or polypeptide is at least 80%, 85%, 90%, 95%, 96%, 97%, 98%, or 99% identical to a nucleotide sequence or polypeptide sequence of the present invention may be determined conventionally using known computer programs. A preferred method for determining the best overall match between a query sequence (a sequence of the present invention) and a subject sequence, also referred to as a global sequence alignment, can be determined using the FASTDB computer program based on the algorithm of Brutlag, et al. (Comp. Appl. Biosci. 6:237-245, 1990). In a sequence alignment, the query and subject sequences are both DNA sequences. An RNA sequence may be compared by converting U's to T's. The result of the global sequence alignment is percent identity. Preferred parameters used in a FASTDB alignment of DNA sequences to calculate percent identity are: Matrix=Unitary, k-tuple=4, Mismatch Penalty=1, Joining Penalty-30, Randomization Group Length=0, Cutoff Score=1, Gap Penalty=5, Gap Size Penalty=0.05, Window Size=500 or the length of the subject nucleotide sequences, whichever is shorter.

If the subject sequence is shorter than the query sequence because of 5' or 3' deletions, not because of internal deletions, a manual correction must be made to the results. This is because the FASTDB program does not account for 5' and 3' truncations of the subject sequence when calculating percent identity. For subject sequences truncated at the 5' or 3' ends, relative to the query sequence, the percent identity is corrected by calculating the number of bases of the query sequence that are 5' and 3' of the subject sequence, which are not matched/aligned, as a percent of the total bases of the query sequence. Whether a nucleotide is matched/aligned is determined by results of the FASTDB sequence alignment. This percentage is then subtracted from the percent identity, calculated by the above FASTDB program using the specified parameters, to arrive at a final percent identity score. This corrected score is what is used for the purposes of the present invention. Only bases outside the 5' and 3' bases of the subject sequence, as displayed by the FASTDB alignment, which are not matched/aligned with the query sequence, are calculated for the purposes of manually adjusting the percent identity score.

For example, a 90 base subject sequence is aligned to a 100 base query sequence to determine percent identity. The deletions occur at the 5' end of the subject sequence and therefore, the FASTDB alignment does not show a matched/aligned of the first 10 bases at 5' end. The 10 unpaired bases represent 10% of the sequence (number of bases at the 5' and 3' ends not matched/total number of bases in the query sequence) so 10% is subtracted from the percent identity score calculated by the FASTDB program. If the remaining 90 bases were perfectly matched the final percent identity would be 90%. In another example, a 90 base subject sequence is compared with a 100 base query sequence. This time the deletions are internal deletions so that there are no bases on the 5' or 3' of the subject sequence which are not matched/aligned with the query. In this case, the percent identity calculated by FASTDB is not manually corrected. Once again, only bases 5' and 3' of the subject sequence which are not matched/aligned with the query sequence are manually corrected. No other manual corrections are to be made for the purposes of the present invention.

Standard recombinant DNA and molecular cloning techniques used here are well known in the art and are described by Sambrook, J., Fritsch, E. F. and Maniatis, T., *Molecular Cloning: A Laboratory Manual*, Second Edition, Cold Spring Harbor Laboratory Press, Cold Spring Harbor, N.Y. (1989); and by Silhavy, T. J., Bennan, M. L. and Enquist, L. W., *Experiments with Gene Fusions*, Cold Spring Harbor Laboratory Press, Cold Spring Harbor, N.Y. (1984); and by Ausubel, F. M. et al., *Current Protocols in Molecular Biology*, published by Greene Publishing Assoc. and Wiley-Interscience (1987). Additional methods used here are in *Methods in Enzymology*, Volume 194, *Guide to Yeast Genetics and Molecular and Cell Biology* (Part A, 2004, Christine Guthrie and Gerald R. Fink (Eds.), Elsevier Academic Press, San Diego, Calif.).

Methods for increasing or for reducing gene expression of the target genes described herein are well known to one skilled in the art. Methods for gene expression in yeasts are known in the art as described, for example, in *Methods in Enzymology*, Volume 194, *Guide to Yeast Genetics and Molecular and Cell Biology* (Part A, 2004, Christine Guthrie and Gerald R. Fink (Eds.), Elsevier Academic Press, San Diego, Calif.). For example, methods for increasing expression include increasing the number of genes that are integrated in the genome or on plasmids that express the target protein, and using a promoter that is more highly expressed than the natural promoter. Promoters that may be operably linked in a constructed chimeric gene for expression include, for example, constitutive promoters FBA1, TDH3, ADH1, and GPM1, and the inducible promoters GAL1, GAL10, and CUP1. Suitable transcriptional terminators that may be used in a chimeric gene construct for expression include, but are not limited to, FBA1t, TDH3t, GPM1t, ERG10t, GAL1t, CYC1t, and ADH1t.

Suitable promoters, transcriptional terminators, and coding regions may be cloned into *E. coli*-yeast shuttle vectors, and transformed into yeast cells. These vectors allow for propagation in both *E. coli* and yeast strains. Typically, the vector contains a selectable marker and sequences allowing autonomous replication or chromosomal integration in the desired host. Plasmids used in yeast are, for example, shuttle vectors pRS423, pRS424, pRS425, and pRS426 (American Type Culture Collection, Rockville, Md.), which contain an *E. coli* replication origin (e.g., pMB1), a yeast 2μ origin of replication, and a marker for nutritional selection. The selection markers for these four vectors are HIS3 (vector pRS423), TRP1 (vector pRS424), LEU2 (vector pRS425), and URA3 (vector pRS426). Construction of expression vectors may be performed by either standard molecular cloning techniques in *E. coli* or by the gap repair recombination method in yeast.

Methods for reducing expression include using genetic modification of the encoding genes. Many methods for genetic modification of target genes to reduce or eliminate expression are known to one skilled in the art and may be used to create the present production host cells. Modifications that may be used include, but are not limited to, deletion of the entire gene or a portion of the gene encoding the protein, inserting a DNA fragment into the encoding gene (in either the promoter or coding region) so that the protein is not expressed or expressed at lower levels, introducing a mutation into the coding region which adds a stop codon or frame shift such that a functional protein is not expressed, and introducing one or more mutations into the coding region to alter amino acids so that a non-functional or a less active protein is expressed. In addition, expression of a target gene may be blocked by expression of an antisense RNA or an interfering RNA, and constructs may be introduced that result in cosuppression. In addition, the synthesis or stability of the transcript may be lessened by mutation. Similarly, the efficiency by which a protein is translated from mRNA may be modulated by mutation. All of these methods may be readily practiced by one skilled in the art making use of the known or identified sequences encoding target proteins.

DNA sequences surrounding a target coding sequence are also useful in some modification procedures. In particular, DNA sequences surrounding, for example, a target gene (e.g., yeast activator protein) coding sequence are useful for modification methods using homologous recombination. For example, in this method, target gene flanking sequences are placed bounding a selectable marker gene to mediate homologous recombination whereby the marker gene replaces the target gene. Also, partial target gene sequences and target gene flanking sequences bounding a selectable marker gene may be used to mediate homologous recombination whereby the marker gene replaces a portion of the target gene. In addition, the selectable marker may be bounded by site-specific recombination sites, so that following expression of the corresponding site-specific recombinase, the resistance gene is excised from the target gene without reactivating the latter. The site-specific recombination leaves behind a recombination site which disrupts expression of the target protein. The homologous recombination vector may be constructed to also leave a deletion in the target gene following excision of the selectable marker, as is well known to one skilled in the art.

Deletions may be made using mitotic recombination as described in Wach, et al. (Yeast 10:1793-1808, 1994). This method involves preparing a DNA fragment that contains a selectable marker between genomic regions that may be as short as 20 bp, and which binds a target DNA sequence. This DNA fragment may be prepared by PCR amplification of the selectable marker gene using as primers (e.g., oligonucleotides) that hybridize to the ends of the marker gene and that include the genomic regions that can recombine with the host cell genome. The linear DNA fragment can be efficiently transformed into the host cell and recombined into the genome resulting in gene replacement including with deletion of the target DNA sequence (as described in Methods in Enzymology, 194:281-301, 1991).

Moreover, promoter replacement methods may be used to exchange the endogenous transcriptional control elements allowing another means to modulate expression (see, e.g., Mnaimneh, et al., Cell 118:31-44, 2004).

In addition, target gene encoded activity may be disrupted using random mutagenesis, which is followed by screening to identify strains with reduced activity. Using this type of method, the DNA sequence of the target gene encoding region, or any other region of the genome affecting activity, need not be known. Methods for creating genetic mutations are common and well known in the art and may be applied to the generation of mutants. Commonly used random genetic modification methods (reviewed in *Methods in Yeast Genetics*, 2005, Cold Spring Harbor Laboratory Press, Cold Spring Harbor, N.Y.) include spontaneous mutagenesis, mutagenesis caused by mutator genes, chemical mutagenesis, irradiation with UV or X-rays, or transposon mutagenesis.

Chemical mutagenesis of yeast commonly involves treatment of yeast cells with one of the following DNA mutagens: ethyl methanesulfonate (EMS), nitrous acid, diethyl sulfate, or N-methyl-N'-nitro-N-nitroso-guanidine (MNNG). These methods of mutagenesis have been reviewed by Spencer, et al. (Mutagenesis in Yeast, 1996, *Yeast Protocols: Methods in Cell and Molecular Biology*. Humana Press, Totowa, N.J.). Chemical mutagenesis with EMS may be performed as described in *Methods in Yeast Genetics*, 2005, Cold Spring Harbor Laboratory Press, Cold Spring Harbor, N.Y. Irradiation with ultraviolet (UV) light or X-rays may also be used to produce random mutagenesis in yeast cells. The primary effect of mutagenesis by UV irradiation is the formation of pyrimidine dimers which disrupt the fidelity of DNA replication. Protocols for UV-mutagenesis of yeast may be found in Spencer, et al. (Mutagenesis in Yeast, 1996, *Yeast Protocols: Methods in Cell and Molecular Biology*. Humana Press, Totowa, N.J.). Introduction of a mutator phenotype may also be used to generate random chromosomal mutations in yeast. Common mutator phenotypes may be obtained through disruption of one or more of the following genes: PMS1, MAG1, RAD18, or RAD51. Restoration of the non-mutator phenotype may be easily obtained by insertion of the wild-type allele. Collections of modified cells produced from any of these or other known random mutagenesis processes may be screened for increased, reduced, or eliminated target gene encoded activity such as yeast activator protein activity or activity of other components of the oxidative stress pathway.

Modification of Stress Response Pathways

In some embodiments of the invention, a recombinant host cell may comprise one or more modifications that alter the expression and/or activity of one or more components of a stress response pathway. For example, the recombinant host cell may comprise one or more modifications that increase the expression and/or activity of one or more components of a stress response pathway. In some embodiments, the components of a stress response pathway may include yeast activator proteins such as Yap1, Yap2, Yap3, Yap4, Yap5, Yap6, Yap7, or Yap8. Examples of yeast activator protein polynucleotides, genes, and polypeptides that may be targeted for modification in a recombinant host cell disclosed herein include, but are not limited to, SEQ ID NO: 2-18. A description of the sequences may be found in Table 4.

TABLE 4

| Nucleotide or Protein | Species/Strain | Sequence Number (SEQ ID NO) |
| --- | --- | --- |
| YAP1 | *Saccharomyces cerevisiae* BY4741 | 2 |
| YAP1 | *Saccharomyces cerevisiae* PNY827 | 3 |
| Yap1 | *Saccharomyces cerevisiae* PNY827 | 4 |
| YAP1 | *Saccharomyces cerevisiae* CEN.PK 113-7D | 5 |
| Yap1 | *Saccharomyces cerevisiae* CEN.PK 113-7D | 6 |
| Yap1 | *Saccharomyces cerevisiae* AWRI1631 | 7 |
| Yap1 | *Saccharomyces cerevisiae* Kyokai saki | 8 |
| Yap1 | *Saccharomyces cerevisiae* Lalvin QA23 | 9 |
| Yap1 | *Saccharomyces cerevisiae* Vin13 | 10 |
| Yap1 | *Saccharomyces cerevisiae* S288C | 11 |
| Yap2 | *Saccharomyces cerevisiae* | 12 |
| Yap3 | *Saccharomyces cerevisiae* | 13 |
| Yap4 | *Saccharomyces cerevisiae* | 14 |
| Yap5 | *Saccharomyces cerevisiae* | 15 |
| Yap6 | *Saccharomyces cerevisiae* | 16 |
| Yap7 | *Saccharomyces cerevisiae* | 17 |
| Yap8 | *Saccharomyces cerevisiae* | 18 |

In some embodiments, the amino acid sequence of these yeast activator proteins may be modified, for example, by amino acid substitutions. As shown in Example 2, the amino acid sequence of the yeast activator protein Yap1 may be modified by amino acid substitutions at any position including amino acid residues 80, 132, 168, 237, 254, 257, 297, 302, 367, 404, 411, 444, 487, 498, 499, 548, 584, 617, and/or 636. Amino acid substitutions at these positions in the amino acid sequence of Yap1 may be conservative or non-conservative amino acid substitutions. For example, amino acid substitution may include substitution with polar amino acids, nonpolar amino acids, basic amino acids, or acidic amino acids. In some embodiments, the amino acid substitutions include those substitutions in SEQ ID NO: 19-27. A description of the sequences may be found in Table 5.

TABLE 5

| YAP1 variant | Amino Acid Substitutions | Sequence Number (SEQ ID NO) |
| --- | --- | --- |
| B5-1 | V254M, A404T | 19 |
| B5-4 | V80A, G132R, C444G | 20 |
| B8-1 | G168D | 21 |
| B8-4 | K487E, N617D | 22 |
| C5-2 | F237L, K297E, I367T, L499F | 23 |
| C5-3 | S411N, G584D, V636I | 24 |
| D8-4 | S257L | 25 |
| E5-4 | L302F, T498M, R548K | 26 |
| F8-1 | L302F, T498M, R548K | 27 |

In some embodiments, these yeast activator proteins may be overexpressed in a recombinant host cell. For example, the wild-type Yap1 or variants of Yap1 (e.g., SEQ ID NO: 2-27) may be expressed in a recombinant host cell. In some embodiments, the wild-type Yap1 and variants of Yap1 may also be overexpressed in a recombinant host cell.

In some embodiments, the amino acid sequence of yeast activator proteins may be modified, for example, by amino acid insertions. In some embodiments, the amino acid sequence of a yeast activator protein may be modified by the insertion of one or more peptide repeat units. In some embodiments, the amino acid sequence of a yeast activator protein may be modified by the insertion of one or more tripeptide repeat units. In some embodiments, at least one tripeptide repeat unit, at least two tripeptide repeat units, at least three tripeptide repeat units, at least four tripeptide repeat units, at least five tripeptide repeat units, at least six tripeptide repeat units, at least seven tripeptide repeat units, at least eight tripeptide repeat units, or more tripeptide repeat units may be inserted into the amino acid sequence of a yeast activator protein. For example, the amino acid sequence of Yap1 may be modified by the insertion of one or more tripeptide repeat units such as Ser-Thr-Asp ("STD") or Ser-Thr-Gly ("STG").

In some embodiments, a yeast activator protein comprising one or more tripeptide repeat units may be expressed in a recombinant microorganism. For example, Yap1 of the strain AWRI796 which comprises seven tripeptide units may be expressed in a recombinant host microorganism as described herein. In some embodiments, the Yap1 amino acid sequences include those amino acids sequences disclosed in SEQ ID NO: 4 and 6-11 and the amino acid sequences encoded by nucleotide sequences disclosed in SEQ ID NO: 2, 3, and 19-27.

In some embodiments of the invention, a recombinant host cell may comprise a modification or disruption of a polynucleotide or gene encoding a polypeptide having yeast activator protein activity or a modification or disruption of a polypeptide having yeast activator protein activity. In some embodiments, the recombinant host cell may comprise a deletion, mutation, insertion, and/or substitution in an endogenous polynucleotide or gene encoding a polypeptide having yeast activator protein activity or in an endogenous polypeptide having yeast activator protein activity. Such modifications, disruptions, deletions, mutations, insertions, and/or substitutions may result in yeast activator protein activity that is reduced or eliminated.

Other examples of yeast activator protein polynucleotides, genes, and polypeptides that may be targeted for modification or inactivation in a recombinant host cell disclosed herein include, but are not limited to, yeast activator protein polynucleotides, genes, and/or polypeptides having at least about 70% to at least about 75%, at least about 75% to at least about 80%, at least about 80% to at least about 85%, at least about 85% to at least about 90%, at least about 90% to at least about 95%, at least about 96%, at least about 97%, at least about 98%, or at least about 99% sequence identity to SEQ ID NOs: 2-27, wherein such a polynucleotide or gene encodes, or such a polypeptide has, yeast activator protein activity. In some embodiments, the yeast activator protein polynucleotides, genes, and/or polypeptides may have at least about 70%, at least about 75%, at least about 80%, at least about 85%, at least about 90%, at least about 95%, at least about 96%, at least about 97%, at least about 98%, or at least about 99% sequence identity to SEQ ID NOs: 2-27, wherein such a polynucleotide or gene encodes, or such a polypeptide has, yeast activator protein activity. Still other examples of yeast activator protein polynucleotides, genes, and polypeptides that may be targeted for modification or inactivation in a recombinant host cell disclosed herein include, but are not limited to, an active variant, fragment, or derivative of SEQ ID NOs: 2-27, wherein such a polynucleotide or gene encodes, or such a polypeptide has, yeast activator protein activity.

In some embodiments, the sequences of other yeast activator protein polynucleotides, genes, and/or polypeptides may be identified in the literature and in bioinformatics databases well known to the skilled person using sequences disclosed herein and available in the art. For example, such sequences may be identified through BLAST searching of publicly available databases with known yeast activator protein-encoding polynucleotide or polypeptide sequences. In such a method, identities may be based on the Clustal W method of alignment using the default parameters of GAP PENALTY=10, GAP LENGTH PENALTY=0.1, and Gonnet 250 series of protein weight matrix.

Additionally, the yeast activator protein polynucleotide or polypeptide sequences disclosed herein or known in the art may be used to identify other yeast activator protein homologs in nature. For example, the yeast activator protein encoding nucleic acid fragments disclosed herein can be used to isolate genes encoding homologous proteins. Isolation of homologous genes using sequence-dependent protocols is well known in the art. Examples of sequence-dependent protocols include, but are not limited to, methods of nucleic acid hybridization; methods of DNA and RNA amplification, as exemplified by various uses of nucleic acid amplification technologies (e.g., polymerase chain reaction (PCR), U.S. Pat. No. 4,683,202; ligase chain reaction (LCR), Tabor, et al., Proc. Acad. Sci. U.S.A. 82:1074, 1985; or strand displacement amplification (SDA), Walker, et al., Proc. Natl. Acad. Sci. U.S.A., 89:392, 1992); and methods of library construction and screening by complementation.

In some embodiments, yeast activator protein polynucleotides, genes, and/or polypeptides related to a recombinant host cell disclosed herein may be modified, for example, overexpressed or disrupted. Many methods for genetic modification of target genes to increase, reduce, or eliminate expression are known to one of ordinary skill in the art and may be used to create a recombinant host cell disclosed herein. The modification of yeast activator protein in a recombinant host cell disclosed herein may be confirmed using methods known in the art. For example, disruption of a particular yeast activator protein may be confirmed with PCR screening using primers internal and external to the yeast activator protein gene or by Southern blot using a probe designed to the yeast activator protein gene sequence.

In some embodiments of the invention, a recombinant host cell may comprise one or more modifications that alter the expression and/or activity of one or more components of a stress response pathway. For example, the recombinant host cell may comprise one or more modifications that increase the expression and/or activity of one or more components of a stress response pathway. In some embodiments, the components of the stress response pathway may include Ybp1, Trx2, Gsh1, Gsh2, Trr1, Gpx2, Tsa1, Ahp1, or Glr1. Examples of components of the stress response pathway polynucleotides, genes, and polypeptides that may be targeted for modification in a recombinant host cell disclosed herein include, but are not limited to, SEQ ID NO: 28-38. A description of the sequences may be found in Table 6.

TABLE 6

| Nucleotide or Protein | Species/Strain | Sequence Number (SEQ ID NO) |
|---|---|---|
| YBP1 | *Saccharomyces cerevisiae* PNY827 | 28 |
| Ybp1 | *Saccharomyces cerevisiae* PNY827 | 29 |
| Ybp1 | *Saccharomyces cerevisiae* S288C | 30 |
| Trx2 | *Saccharomyces cerevisiae* | 31 |
| Gsh1 | *Saccharomyces cerevisiae* | 32 |
| Gsh2 | *Saccharomyces cerevisiae* | 33 |
| Trr1 | *Saccharomyces cerevisiae* | 34 |
| Gpx2 | *Saccharomyces cerevisiae* | 35 |
| Tsa1 | *Saccharomyces cerevisiae* | 36 |
| Ahp1 | *Saccharomyces cerevisiae* | 37 |
| Glr1 | *Saccharomyces cerevisiae* | 38 |

In some embodiments of the invention, a recombinant host cell may comprise a modification or disruption of a polynucleotide or gene encoding a polypeptide of a stress response pathway or a modification or disruption of a polypeptide of a stress response pathway. In some embodiments, the recombinant host cell may comprise a deletion, mutation, insertion, and/or substitution in an endogenous polynucleotide or gene encoding a polypeptide of a stress response pathway or in an endogenous polypeptide of a stress response pathway. Such modifications, disruptions, deletions, mutations, insertions, and/or substitutions may result in reduced or eliminated activity of the component of a stress response pathway. In some embodiments, the components of the stress response pathway may include Ybp1, Trx2, Gsh1, Gsh2, Trr1, Gpx2, Tsa1, Ahp1, or Glr1. Examples of components of the stress response pathway polynucleotides, genes, and polypeptides that may be targeted for modification in a recombinant host cell disclosed herein include, but are not limited to, SEQ ID NO: 28-38.

Other examples of polynucleotides, genes, and polypeptides of a stress response pathway that can be targeted for modification or inactivation in a recombinant host cell disclosed herein include, but are not limited to, polynucleotides, genes, and/or polypeptides having at least about 70% to at least about 75%, at least about 75% to at least about 80%, at least about 80% to at least about 85%, at least about 85% to at least about 90%, at least about 90% to at least about 95%, at least about 96%, at least about 97%, at least about 98%, or at least about 99% sequence identity to SEQ ID NOs: 28-38, wherein such a polynucleotide or gene encodes, or such a polypeptide has, the activity of the component of a stress response pathway such as the activity of Ybp1, Trx2, Gsh1, Gsh2, Trr1, Gpx2, Tsa1, Ahp1, or Glr1, respectively. In some embodiments, the yeast activator protein polynucleotides, genes, and/or polypeptides may have at least about 70%, at least about 75%, at least about 80%, at least about 85%, at least about 90%, at least about 95%, at least about 96%, at least about 97%, at least about 98%, or at least about 99% sequence identity to SEQ ID NOs: 28-38, wherein such a polynucleotide or gene encodes, or such a polypeptide has, the activity of the component of a stress response pathway such as the activity of Ybp1, Trx2, Gsh1, Gsh2, Trr1, Gpx2, Tsa1, Ahp1, or Glr1, respectively. Still other examples of polynucleotides, genes, and polypeptides of a stress response pathway that may be targeted for modification or inactivation in a recombinant host cell disclosed herein include, but are not limited to, an active variant, fragment, or derivative of SEQ ID NOs: 28-38, wherein such a polynucleotide or gene encodes, or such a polypeptide has, the activity of the component of a stress response pathway such as the activity of Ybp1, Trx2, Gsh1, Gsh2, Trr1, Gpx2, Tsa1, Ahp1, or Glr1, respectively.

In some embodiments, the sequences of other polynucleotides, genes, and/or polypeptides of a stress response pathway may be identified in the literature and in bioinformatics databases well known to the skilled person using sequences disclosed herein and available in the art. For example, such sequences may be identified through BLAST searching of publicly available databases with known polynucleotide or polypeptide sequences of components of a stress response pathway. In such a method, identities may be based on the Clustal W method of alignment using the default parameters of GAP PENALTY=10, GAP LENGTH PENALTY=0.1, and Gonnet 250 series of protein weight matrix.

Additionally, the polynucleotide or polypeptide sequences of components of a stress response pathway disclosed herein or known the art may be used to identify other homologs of components of a stress response pathway in nature. For example, the nucleic acid fragments of components of a stress response pathway disclosed herein may be used to isolate genes encoding homologous proteins. Isolation of homologous genes using sequence-dependent protocols is well known in the art. Examples of sequence-dependent protocols include, but are not limited to methods of nucleic acid hybridization; methods of DNA and RNA amplification, as exemplified by various uses of nucleic acid amplification technologies (e.g., polymerase chain reaction (PCR), U.S. Pat. No. 4,683,202; ligase chain reaction (LCR), Tabor, et al., Proc. Acad. Sci. U.S.A. 82:1074, 1985; or strand displacement amplification (SDA), Walker, et al., Proc. Natl. Acad. Sci. U.S.A., 89:392, 1992); and methods of library construction and screening by complementation.

In some embodiments, polynucleotides, genes, and/or polypeptides of a stress response pathway related to a recombinant host cell disclosed herein may be modified, for example, overexpressed or disrupted. Many methods for genetic modification of target genes to increase, reduce, or eliminate expression are known to one of ordinary skill in the art and may be used to create a recombinant host cell disclosed herein. The modification of a component of a stress response pathway in a recombinant host cell disclosed herein may be confirmed using methods known in the art. For example, disruption of a particular component of a stress response pathway may be confirmed with PCR screening using primers internal and external to the gene or by Southern blot using a probe designed to the gene sequence.

Biosynthetic Pathways

In some embodiments, the recombinant host cell may further comprise a butanol biosynthetic pathway as described herein. In some embodiments, the recombinant host cell may comprise an isobutanol biosynthetic pathway, a 1-butanol biosynthetic pathway, a 2-butanol biosynthetic pathway, or a 2-butanone biosynthetic pathway. In some embodiments, the recombinant host cell may comprise one or more polynucleotides encoding one or more polypeptides that catalyzes substrate to product conversions of these biosynthetic pathway. The substrate to product conversions of the isobutanol biosynthetic pathway, a 1-butanol biosynthetic pathway, a 2-butanol biosynthetic pathway, and a 2-butanone biosynthetic pathway are described herein.

Biosynthetic pathways for the production of isobutanol that may be used include those described in U.S. Pat. No. 7,851,188, the entire contents of which are herein incorporated by reference. In some embodiments, the isobutanol biosynthetic pathway comprises the following substrate to product conversions:

a) pyruvate to acetolactate, which may be catalyzed, for example, by acetolactate synthase;

b) acetolactate to 2,3-dihydroxyisovalerate, which may be catalyzed, for example, by acetohydroxy acid reductoisomerase;

c) 2,3-dihydroxyisovalerate to α-ketoisovalerate, which may be catalyzed, for example, by acetohydroxy acid dehydratase;

d) α-ketoisovalerate to isobutyraldehyde, which may be catalyzed, for example, by a branched-chain α-keto acid decarboxylase; and e) isobutyraldehyde to isobutanol, which may be catalyzed, for example, by a branched-chain alcohol dehydrogenase.

In some embodiments, the isobutanol biosynthetic pathway comprises the following substrate to product conversions:

a) pyruvate to acetolactate, which may be catalyzed, for example, by acetolactate synthase;

b) acetolactate to 2,3-dihydroxyisovalerate, which may be catalyzed, for example, by ketol-acid reductoisomerase;

c) 2,3-dihydroxyisovalerate to a-ketoisovalerate, which may be catalyzed, for example, by dihydroxyacid dehydratase;

d) α-ketoisovalerate to valine, which may be catalyzed, for example, by transaminase or valine dehydrogenase;

e) valine to isobutylamine, which may be catalyzed, for example, by valine decarboxylase;

f) isobutylamine to isobutyraldehyde, which may be catalyzed by, for example, omega transaminase; and g) isobutyraldehyde to isobutanol, which may be catalyzed, for example, by a branched-chain alcohol dehydrogenase.

In some embodiments, the isobutanol biosynthetic pathway comprises the following substrate to product conversions:

a) pyruvate to acetolactate, which may be catalyzed, for example, by acetolactate synthase;

b) acetolactate to 2,3-dihydroxyisovalerate, which may be catalyzed, for example, by acetohydroxy acid reductoisomerase;
c) 2,3-dihydroxyisovalerate to α-ketoisovalerate, which may be catalyzed, for example, by acetohydroxy acid dehydratase;
d) α-ketoisovalerate to isobutyryl-CoA, which may be catalyzed, for example, by branched-chain keto acid dehydrogenase;
e) isobutyryl-CoA to isobutyraldehyde, which may be catalyzed, for example, by acelylating aldehyde dehydrogenase; and
f) isobutyraldehyde to isobutanol, which may be catalyzed, for example, by a branched-chain alcohol dehydrogenase.

Biosynthetic pathways for the production of 1-butanol that may be used include those described in U.S. Patent Application Publication No. 2008/0182308, the entire contents of which are herein incorporated by reference. In some embodiments, the 1-butanol biosynthetic pathway comprises the following substrate to product conversions:
a) acetyl-CoA to acetoacetyl-CoA, which may be catalyzed, for example, by acetyl-CoA acetyltransferase;
b) acetoacetyl-CoA to 3-hydroxybutyryl-CoA, which may be catalyzed, for example, by 3-hydroxybutyryl-CoA dehydrogenase;
c) 3-hydroxybutyryl-CoA to crotonyl-CoA, which may be catalyzed, for example, by crotonase;
d) crotonyl-CoA to butyryl-CoA, which may be catalyzed, for example, by butyryl-CoA dehydrogenase;
e) butyryl-CoA to butyraldehyde, which may be catalyzed, for example, by butyraldehyde dehydrogenase; and
f) butyraldehyde to 1-butanol, which may be catalyzed, for example, by butanol dehydrogenase.

Biosynthetic pathways for the production of 2-butanol that may be used include those described in U.S. Patent Application Publication No. 2007/0259410 and U.S. Patent Application Publication No. 2009/0155870, the entire contents of which are herein incorporated by reference. In some embodiments, the 2-butanol biosynthetic pathway comprises the following substrate to product conversions:
a) pyruvate to alpha-acetolactate, which may be catalyzed, for example, by acetolactate synthase;
b) alpha-acetolactate to acetoin, which may be catalyzed, for example, by acetolactate decarboxylase;
c) acetoin to 3-amino-2-butanol, which may be catalyzed, for example, acetonin aminase;
d) 3-amino-2-butanol to 3-amino-2-butanol phosphate, which may be catalyzed, for example, by aminobutanol kinase;
e) 3-amino-2-butanol phosphate to 2-butanone, which may be catalyzed, for example, by aminobutanol phosphate phosphorylase; and
f) 2-butanone to 2-butanol, which may be catalyzed, for example, by butanol dehydrogenase.

In some embodiments, the 2-butanol biosynthetic pathway comprises the following substrate to product conversions:
a) pyruvate to alpha-acetolactate, which may be catalyzed, for example, by acetolactate synthase;
b) alpha-acetolactate to acetoin, which may be catalyzed, for example, by acetolactate decarboxylase;
c) acetoin to 2,3-butanediol, which may be catalyzed, for example, by butanediol dehydrogenase;
d) 2,3-butanediol to 2-butanone, which may be catalyzed, for example, by dial dehydratase; and
e) 2-butanone to 2-butanol, which may be catalyzed, for example, by butanol dehydrogenase.

Biosynthetic pathways for the production of 2-butanone that may be used include those described in U.S. Patent Application Publication No. 2007/0259410 and U.S. Patent Application Publication No. 2009/0155870, the entire contents of which are herein incorporated by reference. In some embodiments, the 2-butanone biosynthetic pathway comprises the following substrate to product conversions:
a) pyruvate to alpha-acetolactate, which may be catalyzed, for example, by acetolactate synthase;
b) alpha-acetolactate to acetoin, which may be catalyzed, for example, by acetolactate decarboxylase;
c) acetoin to 3-amino-2-butanol, which may be catalyzed, for example, acetonin aminase;
d) 3-amino-2-butanol to 3-amino-2-butanol phosphate, which may be catalyzed, for example, by aminobutanol kinase; and,
e) 3-amino-2-butanol phosphate to 2-butanone, which may be catalyzed, for example, by aminobutanol phosphate phosphorylase.

In some embodiments, the 2-butanone biosynthetic pathway comprises the following substrate to product conversions:
a) pyruvate to alpha-acetolactate, which may be catalyzed, for example, by acetolactate synthase;
b) alpha-acetolactate to acetoin which may be catalyzed, for example, by acetolactate decarboxylase;
c) acetoin to 2,3-butanediol, which may be catalyzed, for example, by butanediol dehydrogenase; and
d) 2,3-butanediol to 2-butanone, which may be catalyzed, for example, by diol dehydratase.

In some embodiments, the invention produces butanol from plant-derived carbon sources, avoiding the negative environmental impact associated with standard petrochemical processes for butanol production. In some embodiments, the invention provides a method for the production of butanol using recombinant industrial host cells comprising a butanol pathway.

In some embodiments, the butanol biosynthetic pathways may comprise at least one polynucleotide, at least two polynucleotides, at least three polynucleotides, at least four polynucleotides, at least five polynucleotides, at least six polynucleotides, or at least seven polynucleotides that is/are heterologous to the host cell. In some embodiments, each substrate to product conversion of a butanol biosynthetic pathway in a recombinant host cell may be catalyzed by a heterologous polypeptide. In some embodiments, the polypeptide catalyzing the substrate to product conversions of acetolactate to 2,3-dihydroxyisovalerate and/or the polypeptide catalyzing the substrate to product conversion of isobutyraldehyde to isobutanol are capable of utilizing NADH (reduced nicotinamide adenine dinucleotide) as a cofactor.

The term "acetohydroxyacid synthase," "acetolactate synthase," and "acetolactate synthetase" (abbreviated "ALS"), and in some instances, may be used interchangeably herein, refer to a polypeptide (or polypeptides) having enzyme activity that catalyzes the conversion of pyruvate to acetolactate and $CO_2$. Example acetolactate synthases are known by the EC number 2.2.1.6 (Enzyme Nomenclature 1992, Academic Press, San Diego). These unmodified enzymes are available from a number of sources including, but not limited to, *Bacillus subtilis* (GenBank Nos: CAB15618 (SEQ ID NO: 39), Z99122 (SEQ ID NO: 40), NCBI (National Center for Biotechnology Information) amino acid sequence, NCBI nucleotide sequence, respectively), *Klebsiella pneumoniae* (GenBank Nos: AAA25079 (SEQ ID NO: 41), M73842 (SEQ ID NO: 42)), and *Lactococcus lactis* (GenBank Nos: AAA25161 (SEQ ID NO: 43), L16975 (SEQ ID NO: 44)).

The term "ketol-acid reductoisomerase" ("KARI"), "acetohydroxy acid isomeroreductase," and "acetohydroxy acid reductoisomerase," and in some instances, may be used interchangeably herein, refer to a polypeptide (or polypeptides) having enzyme activity that catalyzes the reaction of (S)-acetolactate to 2,3-dihydroxyisovalerate. Example KARI enzymes may be classified as EC number EC 1.1.1.86 (Enzyme Nomenclature 1992, Academic Press, San Diego), and are available from a vast array of microorganisms including, but not limited to, *Escherichia coli* (GenBank Nos: NP_418222 (SEQ ID NO: 45), NC_000913 (SEQ ID NO: 46)), *Saccharomyces cerevisiae* (GenBank Nos: NP_013459 (SEQ ID NO: 47), NC_001144 (SEQ ID NO: 48)), *Methanococcus maripaludis* (GenBank Nos: CAF30210 (SEQ ID NO: 49), BX957220 (SEQ ID NO: 50)), and *Bacillus subtilis* (GenBank Nos: CAB14789 (SEQ ID NO: 51), Z99118 (SEQ ID NO: 52)). KARIs include *Anaerostipes caccae* KARI variants "K9G9" and "K9D3" (SEQ ID NOs: 53 and 54, respectively). Ketol-acid reductoisomerase (KARI) enzymes are described in U.S. Patent Application Publication Nos. 2008/0261230, 2009/0163376, and 2010/0197519, and PCT Application Publication No. WO/2011/041415, the entire contents of which are herein incorporated by reference. Examples of KARIs disclosed therein are those from *Lactococcus lactis*, *Vibrio cholera*, *Pseudomonas aeruginosa* PAO1, and *Pseudomonas fluorescens* PF5 mutants. In some embodiments, the KARI may utilize NADH. In some embodiments, the KARI may utilize NADPH (reduced nicotinamide adenine dinucleotide phosphate).

The term "acetohydroxy acid dehydratase" and "dihydroxyacid dehydratase" ("DHAD"), and in some instances, may be used interchangeably herein, refer to a polypeptide (or polypeptides) having enzyme activity that catalyzes the conversion of 2,3-dihydroxyisovalerate to α-ketoisovalerate. Example acetohydroxy acid dehydratases are known by the EC number 4.2.1.9. Such enzymes are available from a vast array of microorganisms including, but not limited to, *E. coli* (GenBank Nos: YP_026248 (SEQ ID NO: 55), NC000913 (SEQ ID NO: 56)), *Saccharomyces cerevisiae* (GenBank Nos: NP_012550 (SEQ ID NO: 57), NC 001142 (SEQ ID NO: 58)), *M. maripaludis* (GenBank Nos: CAF29874 (SEQ ID NO: 59), BX957219 (SEQ ID NO: 60)), *B. subtilis* (GenBank Nos: CAB14105 (SEQ ID NO: 61), Z99115 (SEQ ID NO: 62)), *L. lactis*, and *N. crassa*. U.S. Patent Application Publication No. 2010/0081154 and U.S. Pat. No. 7,851,188, the entire contents of which are herein incorporated by reference, describe dihydroxyacid dehydratases (DHADs) including a DHAD from *Streptococcus mutans*.

The term "branched-chain α-keto acid decarboxylase," "α-ketoacid decarboxylase," "α-ketoisovalerate decarboxylase," or "2-ketoisovalerate decarboxylase" ("KIVD"), and in some instances, may be used interchangeably herein, refer to a polypeptide (or polypeptides) having enzyme activity that catalyzes the conversion of α-ketoisovalerate to isobutyraldehyde and $CO_2$. Example branched-chain α-keto acid decarboxylases are known by the EC number 4.1.1.72 and are available from a number of sources including, but not limited to, *Lactococcus lactis* (GenBank Nos: AAS49166 (SEQ ID NO: 63), AY548760 (SEQ ID NO: 64); CAG34226 (SEQ ID NO: 65), AJ746364 (SEQ ID NO: 66), *Salmonella typhimurium* (GenBank Nos: NP_461346 (SEQ ID NO: 67), NC_003197 (SEQ ID NO: 68)), *Clostridium acetobutylicum* (GenBank Nos: NP_149189 (SEQ ID NO: 69), NC_001988 (SEQ ID NO: 70)), *M. caseolyticus* (SEQ ID NO: 71), and *L. grayi* (SEQ ID NO: 72).

The term "branched-chain alcohol dehydrogenase" ("ADH") refers to a polypeptide (or polypeptides) having enzyme activity that catalyzes the conversion of isobutyraldehyde to isobutanol. Example branched-chain alcohol dehydrogenases are known by the EC number 1.1.1.265, but may also be classified under other alcohol dehydrogenases (specifically, EC 1.1.1.1 or 1.1.1.2). Alcohol dehydrogenases may be NADPH dependent or NADH dependent. Such enzymes are available from a number of sources including, but not limited to, *S. cerevisiae* (GenBank Nos: NP_010656 (SEQ ID NO: 73), NC_001136 (SEQ ID NO: 74), NP_014051 (SEQ ID NO: 75), NC_001145 (SEQ ID NO: 76)), *E. coli* (GenBank Nos: NP_417484 (SEQ ID NO: 77), NC_000913 (SEQ ID NO: 78)), *C. acetobutylicum* (GenBank Nos: NP_349892 (SEQ ID NO: 79), NC_003030 (SEQ ID NO: 80); NP_349891 (SEQ ID NO: 81), NC_003030 (SEQ ID NO: 82)). U.S. Patent Application Publication No. 2009/0269823 describes SadB, an alcohol dehydrogenase (ADH) from *Achromobacter xylosoxidans*. Alcohol dehydrogenases also include horse liver ADH and *Beijerinkia indica* ADH (as described by U.S. Patent Application Publication No. 2011/0269199, the entire contents of which are herein incorporated by reference).

The term "butanol dehydrogenase" refers to a polypeptide (or polypeptides) having enzyme activity that catalyzes the conversion of isobutyraldehyde to isobutanol or the conversion of 2-butanone and 2-butanol. Butanol dehydrogenases are a subset of a broad family of alcohol dehydrogenases. Butanol dehydrogenase may be NAD- or NADP-dependent. The NAD-dependent enzymes are known as EC 1.1.1.1 and are available, for example, from *Rhodococcus ruber* (GenBank Nos: CAD36475, AJ491307). The NADP-dependent enzymes are known as EC 1.1.1.2 and are available, for example, from *Pyrococcus furiosus* (GenBank Nos: AAC25556, AF013169). Additionally, a butanol dehydrogenase is available from *Escherichia coli* (GenBank Nos: NP 417484, NC_000913) and a cyclohexanol dehydrogenase is available from *Acinetobacter* sp. (GenBank Nos: AAG10026, AF282240). The term "butanol dehydrogenase" also refers to a polypeptide (or polypeptides) having enzyme activity that catalyzes the conversion of butyraldehyde to 1-butanol, using either NADH or NADPH as cofactor. Butanol dehydrogenases are available from, for example, *C. acetobutylicum* (GenBank Nos: NP_149325, NC_001988; this enzyme possesses both aldehyde and alcohol dehydrogenase activity); NP_349891, NC_003030; and NP_349892, NC_003030) and *E. coli* (GenBank Nos: NP_417-484, NC_000913).

The term "branched-chain keto acid dehydrogenase" refers to a polypeptide (or polypeptides) having enzyme activity that catalyzes the conversion of α-ketoisovalerate to isobutyryl-CoA (isobutyryl-coenzyme A), typically using $NAD^+$ (nicotinamide adenine dinucleotide) as an electron acceptor. Example branched-chain keto acid dehydrogenases are known by the EC number 1.2.4.4. Such branched-chain keto acid dehydrogenases are comprised of four subunits and sequences from all subunits are available from a vast array of microorganisms including, but not limited to, *B. subtilis* (GenBank Nos: CAB14336 (SEQ ID NO: 83), Z99116 (SEQ ID NO: 84); CAB14335 (SEQ ID NO: 85), Z99116 (SEQ ID NO: 86); CAB14334 (SEQ ID NO: 87), Z99116 (SEQ ID NO: 88); and CAB14337 (SEQ ID NO: 89), Z99116 (SEQ ID NO: 90)) and *Pseudomonas putida* (GenBank Nos: AAA65614 (SEQ ID NO: 91), M57613

(SEQ ID NO: 92); AAA65615 (SEQ ID NO: 93), M57613 (SEQ ID NO: 94); AAA65617 (SEQ ID NO: 95), M57613 (SEQ ID NO: 96); and AAA65618 (SEQ ID NO: 97), M57613 (SEQ ID NO: 98)).

The term "acylating aldehyde dehydrogenase" refers to a polypeptide (or polypeptides) having enzyme activity that catalyzes the conversion of isobutyryl-CoA to isobutyraldehyde, typically using either NADH or NADPH as an electron donor. Example acylating aldehyde dehydrogenases are known by the EC numbers 1.2.1.10 and 1.2.1.57. Such enzymes are available from multiple sources including, but not limited to, *Clostridium beijerinckii* (GenBank Nos: AAD31841 (SEQ ID NO: 99), AF157306 (SEQ ID NO: 100)), *C. acetobutylicum* (GenBank Nos: NP_149325 (SEQ ID NO: 101), NC_001988 (SEQ ID NO: 102); NP_149199 (SEQ ID NO: 103), NC_001988 (SEQ ID NO: 104)), *P. putida* (GenBank Nos: AAA89106 (SEQ ID NO: 105), U13232 (SEQ ID NO: 106)), and *Thermus thermophilus* (GenBank Nos: YP_145486 (SEQ ID NO: 107), NC_006461 (SEQ ID NO: 108)).

The term "transaminase" refers to a polypeptide (or polypeptides) having enzyme activity that catalyzes the conversion of α-ketoisovalerate to L-valine, using either alanine or glutamate as an amine donor. Example transaminases are known by the EC numbers 2.6.1.42 and 2.6.1.66. Such enzymes are available from a number of sources. Examples of sources for alanine-dependent enzymes include, but are not limited to, *E. coli* (GenBank Nos: YP_026231 (SEQ ID NO: 109), NC_000913 (SEQ ID NO: 110)) and *Bacillus licheniformis* (GenBank Nos: YP_093743 (SEQ ID NO: 111), NC_006322 (SEQ ID NO: 112)). Examples of sources for glutamate-dependent enzymes include, but are not limited to, *E. coli* (GenBank Nos: YP_026247 (SEQ ID NO: 113), NC_000913 (SEQ ID NO: 114)), *Saccharomyces cerevisiae* (GenBank Nos: NP_012682 (SEQ ID NO: 115), NC_001142 (SEQ ID NO: 116)) and *Methanobacterium thermoautotrophicum* (GenBank Nos: NP_276546 (SEQ ID NO: 117), NC_000916 (SEQ ID NO: 118)).

The term "valine dehydrogenase" refers to a polypeptide (or polypeptides) having enzyme activity that catalyzes the conversion of α-ketoisovalerate to L-valine, typically using NAD(P)H as an electron donor and ammonia as an amine donor. Example valine dehydrogenases are known by the EC numbers 1.4.1.8 and 1.4.1.9 and such enzymes are available from a number of sources including, but not limited to, *Streptomyces coelicolor* (GenBank Nos: NP_628270 (SEQ ID NO: 119), NC_003888 (SEQ ID NO: 120)) and *B. subtilis* (GenBank Nos: CAB14339 (SEQ ID NO: 121), Z99116 (SEQ ID NO: 122)).

The term "valine decarboxylase" refers to a polypeptide (or polypeptides) having enzyme activity that catalyzes the conversion of L-valine to isobutylamine and $CO_2$. Example valine decarboxylases are known by the EC number 4.1.1.14. Such enzymes are found in *Streptomyces* such as, for example, *Streptomyces viridifaciens* (GenBank Nos: AAN10242 (SEQ ID NO: 123), AY116644 (SEQ ID NO: 124)).

The term "omega transaminase" refers to a polypeptide (or polypeptides) having enzyme activity that catalyzes the conversion of isobutylamine to isobutyraldehyde using a suitable amino acid as an amine donor. Example omega transaminases are known by the EC number 2.6.1.18 and are available from a number of sources including, but not limited to, *Alcaligenes denitrificans* (AAP92672 (SEQ ID NO: 125), AY330220 (SEQ ID NO: 126)), *Ralstonia eutropha* (GenBank Nos: YP_294474 (SEQ ID NO: 127), NC_007347 (SEQ ID NO: 128)), *Shewanella oneidensis* (GenBank Nos: NP_719046 (SEQ ID NO: 129), NC_004347 (SEQ ID NO: 130)), and *P. putida* (GenBank Nos: AAN66223 (SEQ ID NO: 131), AE016776 (SEQ ID NO: 132)).

The term "acetyl-CoA acetyltransferase" refers to a polypeptide (or polypeptides) having enzyme activity that catalyzes the conversion of two molecules of acetyl-CoA to acetoacetyl-CoA and coenzyme A (CoA). Example acetyl-CoA acetyltransferases are acetyl-CoA acetyltransferases with substrate preferences (reaction in the forward direction) for a short chain acyl-CoA and acetyl-CoA and are classified as E.C. 2.3.1.9 [Enzyme Nomenclature 1992, Academic Press, San Diego]; although, enzymes with a broader substrate range (E.C. 2.3.1.16) will be functional as well. Acetyl-CoA acetyltransferases are available from a number of sources, for example, *Escherichia coli* (GenBank Nos: NP_416728, NC_000913; NCBI amino acid sequence, NCBI nucleotide sequence)), *Clostridium acetobutylicum* (GenBank Nos: NP_349476.1, NC_003030; NP_149242, NC_001988, *Bacillus subtilis* (GenBank Nos: NP_390297, NC_000964), and *Saccharomyces cerevisiae* (GenBank Nos: NP_015297, NC_001148).

The term "3-hydroxybutyryl-CoA dehydrogenase" refers to a polypeptide (or polypeptides) having enzyme activity that catalyzes the conversion of acetoacetyl-CoA to 3-hydroxybutyryl-CoA. Example 3-hydroxybutyryl-CoA dehydrogenases may be reduced nicotinamide adenine dinucleotide (NADH)-dependent, with a substrate preference for (S)-3-hydroxybutyryl-CoA or (R)-3-hydroxybutyryl-CoA. Examples may be classified as E.C. 1.1.1.35 and E.C. 1.1.1.30, respectively. Additionally, 3-hydroxybutyryl-CoA dehydrogenases may be reduced nicotinamide adenine dinucleotide phosphate (NADPH)-dependent, with a substrate preference for (S)-3-hydroxybutyryl-CoA or (R)-3-hydroxybutyryl-CoA and are classified as E.C. 1.1.1.157 and E.C. 1.1.1.36, respectively. 3-Hydroxybutyryl-CoA dehydrogenases are available from a number of sources, for example, *C. acetobutylicum* (GenBank Nos: NP_349314, NC_003030), *B. subtilis* (GenBank Nos: AAB09614, U29084), *Ralstonia eutropha* (GenBank Nos: YP_294481, NC_007347), and *Alcaligenes eutrophus* (GenBank Nos: AAA21973, J04987).

The term "crotonase" refers to a polypeptide (or polypeptides) having enzyme activity that catalyzes the conversion of 3-hydroxybutyryl-CoA to crotonyl-CoA and $H_2O$. Example crotonases may have a substrate preference for (S)-3-hydroxybutyryl-CoA or (R)-3-hydroxybutyryl-CoA and may be classified as E.C. 4.2.1.17 and E.C. 4.2.1.55, respectively. Crotonases are available from a number of sources, for example, *E. coli* (GenBank Nos: NP_415911, NC_000913), *C. acetobutylicum* (GenBank Nos: NP_349318, NC_003030), *B. subtilis* (GenBank Nos: CAB13705, Z99113), and *Aeromonas caviae* (GenBank Nos: BAA21816, D88825).

The term "butyryl-CoA dehydrogenase" refers to a polypeptide (or polypeptides) having enzyme activity that catalyzes the conversion of crotonyl-CoA to butyryl-CoA. Example butyryl-CoA dehydrogenases may be NADH-dependent, NADPH-dependent, or flavin-dependent and may be classified as E.C. 1.3.1.44, E.C. 1.3.1.38, and E.C. 1.3.99.2, respectively. Butyryl-CoA dehydrogenases are available from a number of sources, for example, *C. acetobutylicum* (GenBank Nos: NP_347102, NC_003030), *Euglena gracilis* (GenBank Nos: Q5EU90), AY741582),

*Streptomyces collinus* (GenBank Nos: AAA92890, U37135), and *Streptomyces coelicolor* (GenBank Nos: CAA22721, AL939127).

The term "butyraldehyde dehydrogenase" refers to a polypeptide (or polypeptides) having enzyme activity that catalyzes the conversion of butyryl-CoA to butyraldehyde, using NADH or NADPH as cofactor. Butyraldehyde dehydrogenases with a preference for NADH are known as E.C. 1.2.1.57 and are available from, for example, *Clostridium beijerinckii* (GenBank Nos: AAD31841, AF157306) and *C. acetobutylicum* (GenBank Nos: NP.sub.-149325, NC.sub.-001988).

The term "isobutyryl-CoA mutase" refers to a polypeptide (or polypeptides) having enzyme activity that catalyzes the conversion of butyryl-CoA to isobutyryl-CoA. This enzyme uses coenzyme $B_{12}$ as cofactor. Example isobutyryl-CoA mutases are known by the EC number 5.4.99.13. These enzymes are found in a number of *Streptomyces* including, but not limited to, *Streptomyces cinnamonensis* (GenBank Nos: AAC08713 (SEQ ID NO: 133), U67612 (SEQ ID NO: 134); CAB59633 (SEQ ID NO: 135), AJ246005 (SEQ ID NO: 136)), *S. coelicolor* (GenBank Nos: CAB70645 (SEQ ID NO: 137), AL939123 (SEQ ID NO: 138); CAB92663 (SEQ ID NO: 139), AL939121 (SEQ ID NO: 140)), and *Streptomyces avermitilis* (GenBank Nos: NP_824008 (SEQ ID NO: 141), NC_003155 (SEQ ID NO: 142); NP_824637 (SEQ ID NO: 143), NC_003155 (SEQ ID NO: 144)).

The term "acetolactate decarboxylase" refers to a polypeptide (or polypeptides) having enzyme activity that catalyzes the conversion of alpha-acetolactate to acetoin. Example acetolactate decarboxylases are known as EC 4.1.1.5 and are available, for example, from *Bacillus subtilis* (GenBank Nos: AAA22223, L04470), *Klebsiella terrigena* (GenBank Nos: AAA25054, L04507), and *Klebsiella pneumoniae* (GenBank Nos: AAU43774, AY722056).

The term "acetoin aminase" or "acetoin transaminase," and in some instances, may be used interchangeably herein, refer to a polypeptide (or polypeptides) having enzyme activity that catalyzes the conversion of acetoin to 3-amino-2-butanol. Acetoin aminase may utilize the cofactor pyridoxal 5'-phosphate or NADH or NADPH. The resulting product may have (R) or (S) stereochemistry at the 3-position. The pyridoxal phosphate-dependent enzyme may use an amino acid such as alanine or glutamate as the amino donor. The NADH- and NADPH-dependent enzymes may use ammonia as a second substrate. A suitable example of an NADH dependent acetoin aminase, also known as amino alcohol dehydrogenase, is described by Ito, et al. (U.S. Pat. No. 6,432,688). An example of a pyridoxal-dependent acetoin aminase is the amine:pyruvate aminotransferase (also called amine:pyruvate transaminase) described by Shin and Kim (J. Org. Chem. 67:2848-2853, 2002).

The term "acetoin kinase" refers to a polypeptide (or polypeptides) having enzyme activity that catalyzes the conversion of acetoin to phosphoacetoin. Acetoin kinase may utilize ATP (adenosine triphosphate) or phosphoenolpyruvate as the phosphate donor in the reaction. Enzymes that catalyze the analogous reaction on the similar substrate dihydroxyacetone, for example, include enzymes known as EC 2.7.1.29 (Garcia-Alles, et al., Biochemistry 43:13037-13046, 2004).

The term "acetoin phosphate aminase" refers to a polypeptide (or polypeptides) having enzyme activity that catalyzes the conversion of phosphoacetoin to 3-amino-2-butanol O-phosphate. Acetoin phosphate aminase may use the cofactor pyridoxal 5'-phosphate, NADH, or NADPH. The resulting product may have (R) or (S) stereochemistry at the 3-position. The pyridoxal phosphate-dependent enzyme may use an amino acid such as alanine or glutamate. The NADH and NADPH-dependent enzymes may use ammonia as a second substrate. Although there are no reports of enzymes catalyzing this reaction on phosphoacetoin, there is a pyridoxal phosphate-dependent enzyme that is proposed to carry out the analogous reaction on the similar substrate serinol phosphate (Yasuta, et al., Appl. Environ. Microbial. 67:4999-5009, 2001).

The term "aminobutanol phosphate phospholyase," also called "amino alcohol O-phosphate lyase," and in some instances, may be used interchangeably herein, refers to a polypeptide (or polypeptides) having enzyme activity that catalyzes the conversion of 3-amino-2-butanol O-phosphate to 2-butanone. Amino butanol phosphate phospho-lyase may utilize the cofactor pyridoxal 5'-phosphate. There are reports of enzymes that catalyze the analogous reaction on the similar substrate 1-amino-2-propanol phosphate (Jones, et al., Biochem J. 134:167-182, 1973). U.S. Patent Application Publication No. 2007/0259410 describes an aminobutanol phosphate phospho-lyase from the organism *Erwinia carotovora*.

The term "aminobutanol kinase" refers to a polypeptide (or polypeptides) having enzyme activity that catalyzes the conversion of 3-amino-2-butanol to 3-amino-2-butanol O-phosphate. Amino butanol kinase may utilize ATP as the phosphate donor. Although there are no reports of enzymes catalyzing this reaction on 3-amino-2-butanol, there are reports of enzymes that catalyze the analogous reaction on the similar substrates ethanolamine and 1-amino-2-propanol (Jones, et al., supra). U.S. Patent Application Publication No. 2009/0155870 describes, in Example 14, an amino alcohol kinase of *Erwinia carotovora* subsp. *Atroseptica*.

The term "butanediol dehydrogenase," also known as "acetoin reductase," and in some instances, may be used interchangeably herein, refers to a polypeptide (or polypeptides) having enzyme activity that catalyzes the conversion of acetoin to 2,3-butanediol. Butanedial dehydrogenases are a subset of the broad family of alcohol dehydrogenases. Butanediol dehydrogenase enzymes may have specificity for production of (R)- or (S)-stereochemistry in the alcohol product. (S)-specific butanediol dehydrogenases are known as EC 1.1.1.76 and are available, for example, from *Klebsiella pneumoniae* (GenBank Nos: BBA13085, D86412). (R)-specific butanediol dehydrogenases are known as EC 1.1.1.4 and are available, for example, from *Bacillus cereus* (GenBank Nos. NP 830481, NC_004722; AAP07682, AE017000), and *Lactococcus lactis* (GenBank Nos. AAK04995, AE006323).

The term "butanediol dehydratase," also known as "dial dehydratase" or "propanediol dehydratase," and in some instances, may be used interchangeably herein, refers to a polypeptide (or polypeptides) having an enzyme activity that catalyzes the conversion of 2,3-butanediol to 2-butanone. Butanediol dehydratase may utilize the cofactor adenosyl cobalamin (also known as coenzyme Bw or vitamin B12; although vitamin B12 may refer also to other forms of cobalamin that are not coenzyme B12). Adenosyl cobalamin-dependent enzymes are known as EC 4.2.1.28 and are available, for example, from *Klebsiella oxytoca* [(GenBank Nos: AA08099 (alpha subunit), D45071; BAA08100 (beta subunit), D45071; and BBA08101 (gamma subunit), D45071 (Note all three subunits are required for activity)], and *Klebsiella pneumonia* (GenBank Nos: AAC98384 (alpha subunit), AF102064; GenBank Nos: AAC98385 (beta subunit), AF102064, GenBank Nos: AAC98386 (gamma subunit), AF102064). Other suitable dial dehydratases include, but are not limited to, B12-dependent dial dehydratases available from *Salmonella typhimurium* (GenBank Nos: AAB84102 (large subunit), AF026270; GenBank Nos: AAB84103 (medium subunit), AF026270; GenBank Nos: AAB84104 (small subunit), AF026270); and *Lactobacillus collinoides* (GenBank Nos: CAC82541 (large subunit), AJ297723; GenBank Nos: CAC82542 (medium subunit); AJ297723; GenBank Nos: CAD01091 (small subunit), AJ297723); and enzymes from *Lactobacillus brevis* (particularly strains CNRZ 734 and CNRZ 735, Speranza, et al., J. Agric. Food Chem. 45:3476-3480, 1997), and nucleotide sequences that encode the corresponding enzymes. Methods of dial dehydratase gene isolation are well known in the art (e.g., U.S. Pat. No. 5,686,276).

The term "pyruvate decarboxylase" refers to a polypeptide (or polypeptides) having an enzyme activity that catalyzes the decarboxylation of pyruvic acid to acetaldehyde and carbon dioxide. Pyruvate dehydrogenases are known by the EC number 4.1.1.1. These enzymes are found in a number of yeast including *Saccharomyces cerevisiae* (GenBank Nos: CAA97575 (SEQ ID NO: 145), CAA97705 (SEQ ID NO: 147), CAA97091 (SEQ ID NO: 149)).

It will be appreciated that host cells comprising a butanol biosynthetic pathway as provided herein may further comprise one or more additional modifications. U.S. Patent Application Publication No. 2009/0305363, the entire contents of which are herein incorporated by reference, discloses increased conversion of pyruvate to acetolactate by engineering yeast for expression of a cytosol-localized acetolactate synthase and substantial elimination of pyruvate decarboxylase activity. In some embodiments, the host cells comprise modifications to reduce glycerol-3-phosphate dehydrogenase activity and/or disruption in at least one gene encoding a polypeptide having pyruvate decarboxylase activity or a disruption in at least one gene encoding a regulatory element controlling pyruvate decarboxylase gene expression as described in U.S. Patent Application Publication No. 2009/0305363, modifications to a host cell that provide for increased carbon flux through an Entner-Doudoroff Pathway or reducing equivalents balance as described in U.S. Patent Application Publication No. 2010/0120105, the entire contents of which are herein incorporated by reference. Other modifications include integration of at least one polynucleotide encoding a polypeptide that catalyzes a step in a pyruvate-utilizing biosynthetic pathway. Other modifications include at least one deletion, mutation, insertion, and/or substitution in an endogenous polynucleotide encoding a polypeptide having acetolactate reductase activity. In some embodiments, the polypeptide having acetolactate reductase activity is YMR226C (SEQ ID NOs: 165, 166) of *Saccharomyces cerevisiae* or a homolog thereof. Additional modifications include a deletion, mutation, insertion, and/or substitution in an endogenous polynucleotide encoding a polypeptide having aldehyde dehydrogenase and/or aldehyde oxidase activity. In some embodiments, the polypeptide having aldehyde dehydrogenase activity is ALD6 from *Saccharomyces cerevisiae* or a homolog thereof. A genetic modification which has the effect of reducing glucose repression wherein the yeast production host cell is pdc- is described in U.S. Patent Application Publication No. 2011/0124060, the entire contents of which are herein incorporated by reference. In some embodiments, the pyruvate decarboxylase that is deleted or down-regulated is PDC1, PDC5, PDC6, or combinations thereof. In some embodiments, the pyruvate decarboxylase is selected from those enzymes in Table 7. In some embodiments, host cells may contain a deletion or down-regulation of a polynucleotide encoding a polypeptide that catalyzes the conversion of glyceraldehyde-3-phosphate to glycerate 1,3, bisphosphate. In some embodiments, the enzyme that catalyzes this reaction is glyceraldehyde-3-phosphate dehydrogenase.

TABLE 7

SEQ ID Numbers of PDC Target Gene coding regions and Proteins

| Description | SEQ ID NO: Amino Acid | SEQ ID NO: Nucleic Acid |
|---|---|---|
| PDC1 pyruvate decarboxylase from *Saccharomyces cerevisiae* | 145 | 146 |
| PDC5 pyruvate decarboxylase from *Saccharomyces cerevisiae* | 147 | 148 |
| PDC6 pyruvate decarboxylase *Saccharomyces cerevisiae* | 149 | 150 |
| pyruvate decarboxylase from *Candida glabrata* | 151 | 152 |
| PDC1 pyruvate decarboxylase from *Pichia stipitis* | 153 | 154 |
| PDC2 pyruvate decarboxylase from *Pichia stipitis* | 155 | 156 |
| pyruvate decarboxylase from *Kluyveromyces lactis* | 157 | 158 |
| pyruvate decarboxylase from *Yarrowia lipolytica* | 159 | 160 |
| pyruvate decarboxylase from *Schizosaccharomyces pombe* | 161 | 162 |
| pyruvate decarboxylase from *Zygosaccharomyces rouxii* | 163 | 164 |

Yeasts may have one or more genes encoding pyruvate decarboxylase. For example, there is one gene encoding pyruvate decarboxylase in *Candida glabrata* and *Schizosaccharomyces pombe*, while there are three isozymes of pyruvate decarboxylase encoded by the PDC1, PCD5, and PDC6 genes in *Saccharomyces*. In some embodiments, at least one PDC gene may be inactivated. If the yeast cell used has more than one expressed (active) PDC gene, then each of the active PDC genes may be modified or inactivated thereby producing a pdc-cell. For example, in *Saccharomyces cerevisiae*, the PDC1, PDC5, and PDC6 genes may be modified or inactivated. If a PDC gene is not active under the fermentation conditions to be used, then such a gene would not need to be modified or inactivated.

Other target genes, such as those encoding pyruvate decarboxylase proteins having at least about 70% to at least about 75%, at least about 75% to at least about 80%, at least about 80% to at least about 85%, at least about 85% to at least about 90%, at least about 90% to at least about 95%, at least about 96%, at least about 97%, at least about 98%, or at least about 99% sequence identity to the pyruvate decarboxylases of SEQ ID NOs: 145, 147, 149, 151, 153, 155, 157, 159, 161, or 163 may be identified in the literature and in bioinformatics databases well known to the skilled person. In some embodiments, target genes, such as those encoding pyruvate decarboxylase proteins having at least about 70%, at least about 75%, at least about 80%, at least about 85%, at least about 90%, at least about 95%, at least about 96%, at least about 97%, at least about 98%, or at least about 99% sequence identity to the pyruvate decarboxylases of SEQ ID NOs: 145, 147, 149, 151, 153, 155, 157, 159, 161, or 163 may be identified in the literature and in bioinformatics databases well known to the skilled person.

Recombinant host cells may further comprise (a) at least one heterologous polynucleotide encoding a polypeptide having dihydroxy-acid dehydratase activity; and (b)(i) at least one deletion, mutation, insertion, and/or substitution in an endogenous gene encoding a polypeptide affecting Fe—S cluster biosynthesis; and/or (ii) at least one heterologous polynucleotide encoding a polypeptide affecting Fe—S cluster biosynthesis. In some embodiments, the polypeptide affecting Fe—S cluster biosynthesis may be encoded by AFT1, AFT2, FRA2, GRX3 or CCC1. AFT1 and AFT2 are described in PCT Application Publication No. WO 2001/103300, the entire contents of which are herein incorporated by reference. In some embodiments, the polypeptide affecting Fe—S cluster biosynthesis may be constitutive mutant AFT1 L99A, AFT1 L102A, AFT1 C291F, or AFT1 C293F. In some embodiments, the recombinant host cell may further comprise a deletion, mutation, insertion, and/or substitution in glycerol dehydrogenase (GPD2) or phosphodiesterase (PDE1). In some embodiments, the recombinant host cell may further comprise reduced or eliminated Gpd2 activity. In some embodiments, the recombinant host cell may further comprise reduced or eliminated Pde1 activity.

Butanol Production

Disclosed herein are processes suitable for production of butanol from a carbon substrate and employing a recombinant host cell. In some embodiments, recombinant host cells may comprise an isobutanol biosynthetic pathway such as, but not limited to, isobutanol biosynthetic pathways disclosed herein. The ability to utilize carbon substrates to produce isobutanol may be confirmed using methods known in the art including, but not limited to, those described in U.S. Pat. No. 7,851,188, the entire contents of which are herein incorporated by reference. For example, to confirm utilization of sucrose to produce isobutanol, the concentration of isobutanol in the culture media may be determined by a number of methods known in the art such as a specific high performance liquid chromatography (HPLC) method utilizing a Shodex SH-1011 column with a Shodex SH-G guard column (Waters Corporation, Milford, Mass.), with refractive index (RI) detection. Chromatographic separation may be achieved using 0.01 M $H_2SO_4$ as the mobile phase with a flow rate of 0.5 mL/min and a column temperature of 50° C., and isobutanol has a retention time of 46.6 min under these conditions. Alternatively, gas chromatography (GC) methods are available such as a specific GC method utilizing an HP-INNOWax column (30 m×0.53 mm id, 1 μm film thickness, Agilent Technologies, Wilmington, Del.) with a flame ionization detector (FID). The carrier gas is helium at a flow rate of 4.5 mL/min, measured at 150° C. with constant head pressure; injector split is 1:25 at 200° C.; oven temperature is 45° C. for 1 min, 45° C. to 220° C. at 10° C./min, and 220° C. for 5 min; and FID detection is employed at 240° C. with 26 mL/min helium makeup gas. The retention time of isobutanol is 4.5 min under these conditions.

An embodiment of the invention is directed to a process for producing butanol comprising:
(a) providing a recombinant host cell, wherein the host cell produces butanol;
(b) contacting the recombinant host cell with one or more carbon substrates under conditions wherein butanol is produced at an effective yield;
(c) collecting the recombinant host cell;
(d) recovering butanol;
(e) contacting the collected recombinant host cell of (c) with one or more carbon substrates under conditions wherein butanol is produced at an effective yield;
(f) optionally repeating steps (c)-(e).

In some embodiments, butanol is recovered at a concentration of at least about 6 g/L. In some embodiments, the effective yield of step (e) is at least about 90% of the effective yield of (b). In some embodiments, the recombinant host cell is exposed for at least about one hour and/or in the presence of at least about 0.3% butanol. In some embodiments, the butanol produced is isobutanol. In some embodiments, the butanol produced is 1-butanol. In some embodiments, the butanol produced is 2-butanol. In some embodiments, the butanol produced is 2-butanone.

In some embodiments, the recombinant host cell may be engineered. In some embodiments, the engineered recombinant host cell may comprise a butanol biosynthetic pathway. In some embodiments, the butanol biosynthetic pathway may be a 1-butanol biosynthetic pathway, 2-butanol biosynthetic pathway, isobutanol biosynthetic pathway, or 2-butanone biosynthetic pathway. In some embodiments, the recombinant host cell is a butanologen. In some embodiments, the recombinant host cell is an isobutanologen. In some embodiments, the recombinant host cell is yeast. In some embodiments, the recombinant host cell is a member of a genus of *Saccharomyces, Schizosaccharomyces, Hansenula, Candida, Kluyveromyces, Yarrowia, Issatchenkia,* or *Pichia.* In some embodiments, the recombinant host cell is *Saccharomyces cerevisiae.*

In some embodiments, the recombinant host cell may also contain one or more polypeptides selected from a group of enzymes having the following Enzyme Commission Numbers: EC 2.2.1.6, EC 1.1.1.86, EC 4.2.1.9, EC 4.1.1.72, EC 1.1.1.1, EC 1.1.1.265, EC 1.1.1.2, EC 1.2.4.4, EC 1.3.99.2, EC 1.2.1.57, EC 1.2.1.10, EC 2.6.1.66, EC 2.6.1.42, EC 1.4.1.9, EC 1.4.1.8, EC 4.1.1.14, EC 2.6.1.18, EC 2.3.1.9, EC 2.3.1.16, EC 1.1.130, EC 1.1.1.35, EC 1.1.1.157, EC 1.1.1.36, EC 4.2.1.17, EC 4.2.1.55, EC 1.3.1.44, EC 1.3.1.38, EC 5.4.99.13, EC 4.1.1.5, EC 2.7.1.29, EC 1.1.1.76, EC 1.2.1.57, and EC 4.2.1.28.

In some embodiments, the recombinant host cell may contain one or more polypeptides selected from acetolactate synthase, acetohydroxy acid isomeroreductase, acetohydroxy acid dehydratase, branched-chain alpha-keto acid decarboxylase, branched-chain alcohol dehydrogenase, acylating aldehyde dehydrogenase, branched-chain keto acid dehydrogenase, butyryl-CoA dehydrogenase, butyraldehyde dehydrogenase, transaminase, valine dehydrogenase, valine decarboxylase, omega transaminase, acetyl-CoA acetyltransferase, 3-hydroxybutyryl-CoA dehydrogenase, crotonase, butyryl-CoA dehydrogenase, isobutyryl-CoA mutase, acetolactate decarboxylase, acetonin aminase, butanol dehydrogenase, butyraldehyde dehydrogenase, acetoin kinase, acetoin phosphate aminase, aminobutanol phosphate phospholyase, aminobutanol kinase, butanediol dehydrogenase, and butanediol dehydratase.

In some embodiments, the carbon substrate may be oligosaccharides, polysaccharides, monosaccharides, or mixtures thereof. In some embodiments, the carbon substrate may be fructose, glucose, lactose, maltose, galactose, sucrose, starch, cellulose, feedstocks, ethanol, lactate, succinate, glycerol, corn mash, sugar cane, biomass, a C5 sugar, such as xylose and arabinose, or mixtures thereof.

In some embodiments, the recombinant host cell may be present at a cell density of at least about 0.5 gdcw/L at the first contacting with the carbon substrate. In some embodiments, the recombinant host cell may be grown to a cell density of at least about 6 gdcw/L prior to contacting with carbon substrate for the production of isobutanol. In some embodiments, the cell density may be at least about 20 gdcw/L, at least about 25 gdcw/L, or at least about 35 gdcw/L, prior to contact with carbon substrate.

In some embodiments, the recombinant host cell of step (a) may be have a specific productivity of at least about 0.1 g/gdcw/h. In some embodiments, butanol may be produced at an effective rate of at least about 0.1 g/gdcw/h during the first contacting with the carbon substrate. In some embodiments, the first contacting with the carbon substrate may occur in the presence of an extractant. In some embodiments, the recombinant host cell may maintain a sugar uptake rate of at least about 1.0 g/gdcw/h. In some embodiments, the recombinant host cell may maintain a sugar uptake rate of at least about 0.5 g/g/hr. In some embodiments, the glucose utilization rate may be at least about 2.5 g/gdcw/h. In some embodiments, the sucrose uptake rate may be at least about 2.5 g/gdcw/h. In some embodiments, the combined glucose and fructose uptake rate may be at least about 2.5 g/gdcw/h. In some embodiments, contacting with the carbon substrate may occur in anaerobic conditions. In some embodiments, contacting with the carbon substrate may occur in microaerobic conditions.

In some embodiments, the engineered isobutanol pathway may comprise the following substrate to product conversions:
  a. pyruvate to acetolactate
  b. acetolactate to 2,3-dihydroxyisovalerate
  c. 2,3-dihydroxyisovalerate to α-ketoisovalerate
  d. α-ketoisovalerate to isobutyraldehyde, and
  e. isobutyraldehyde to isobutanol.

In some embodiments, one or more of the substrate to product conversions may utilize NADH or NADPH as a cofactor. In some embodiments, the recombinant host cell comprises an engineered enzyme which catalyzed the substrate to product conversion acetolactate to 2,3-dihydroxyisovalerate.

The present invention is also directed to compositions comprising a recombinant host cell comprising an engineered butanol biosynthetic pathway. In some embodiments, the engineered butanol biosynthetic pathway may be a 1-butanol biosynthetic pathway, 2-butanol biosynthetic pathway, isobutanol biosynthetic pathway, or 2-butanone biosynthetic pathway. In some embodiments, the recombinant host cell of the composition is a member of the genus *Saccharomyces, Schizosaccharomyces, Hansenula, Candida, Kluyveromyces, Yarrowia, Issatchenkia,* or *Pichia.* In some embodiments, the recombinant host cell of the composition is *Saccharomyces cerevisiae.* In some embodiments, the recombinant host cell comprises an engineered enzyme which catalyzed the substrate to product conversion acetolactate to 2,3-dihydroxyisovalerate.

In some embodiments, enzymes from the biosynthetic pathway may be localized to the cytosol. In some embodiments, enzymes from the biosynthetic pathway that are usually localized to the mitochondria may be localized to the cytosol. In some embodiments, an enzyme from the biosynthetic pathway may be localized to the cytosol by removing the mitochondrial targeting sequence. In some embodiments, mitochondrial targeting may be eliminated by generating new start codons as described in, for example, U.S. Pat. No. 7,851,188, which is incorporated herein by reference in its entirety. In some embodiments, the enzyme from the biosynthetic pathway that is localized to the cytosol is DHAD. In some embodiments, the enzyme from the biosynthetic pathway that is localized to the cytosol is KARI.

In some embodiments, the recombinant host cell is contacted with carbon substrates under conditions whereby butanol is produced. In some embodiments, butanol may be 1-butanol, 2-butanol, isobutanol, or 2-butanone. In some embodiments, the recombinant host cell at a given cell density may be added to a fermentation vessel along with suitable media. In some embodiments, the media may contain the carbon substrate, or the carbon substrate may be added separately. In some embodiments, the carbon substrate may be present at any concentration at the start of and/or during production of butanol. In some embodiments, the initial concentration of carbon substrate may be in the range of about 60 to about 80 g/L. Suitable temperatures for fermentation are known to those of skill in the art and will depend on the genus and/or species of the recombinant host cell employed. In some embodiments, suitable temperatures are in the range of 25° C. to 43° C. The contact between the recombinant host cell and the carbon substrate may be any length of time whereby butanol is produced. In some embodiments, the contact occurs for at least about 8 hours, at least about 24 hours, or at least about 48 hours. In some embodiments, the contact occurs for less than about 8 hours. In some embodiments, the contact may occur until at least about 90% of the carbon substrate (e.g., sucrose) is utilized or until a desired effective titer of butanol is reached. In some embodiments when isobutanol is produced, the effective titer of isobutanol is at least about 40 g/L, at least about 50 g/L, at least about 60 g/L, at least about 70 g/L, at least about 80 g/L, at least about 90 g/L, at least about 100 g/L, or at least about 110 g/L.

In some embodiments, after the desired butanol production, the recombinant host cell is collected. The collection may be carried out by any method known in the art, including, for example, centrifugation. In some embodiments, the collected recombinant host cell may be recycled. In some embodiments, the collected recombinant host cell may be conducted to a fermentation vessel.

In some embodiments, the recombinant host cell produces butanol at least about 90% of effective yield, at least about 91% of effective yield, at least about 92% of effective yield, at least about 93% of effective yield, at least about 94% of effective yield, at least about 95% of effective yield, at least about 96% of effective yield, at least about 97% of effective yield, at least about 98% of effective yield, or at least about 99% of effective yield. In some embodiments, the recombinant host cell may produce butanol at least about 55% to at least about 75% of effective yield, at least about 50% to at least about 80% of effective yield, at least about 45% to at least about 85% of effective yield, at least about 40% to at least about 90% of effective yield, at least about 35% to at least about 95% of effective yield, at least about 30% to at least about 99% of effective yield, at least about 25% to at least about 99% of effective yield, at least about 10% to at least about 99% of effective yield, or at least about 10% to at least about 100% of effective yield.

Butanologens

In some embodiments, the recombinant host cell may be a butanolgen. In some embodiments, the butanologen may be an isobutanologen. In some embodiments, the recombinant host cell may be *E. coli* or *L. plantarum.* In some embodiments, suitable isobutanologens include any yeast host useful for genetic modification and recombinant gene expression. In some embodiments, the isobutanologen host cell may be a member of the genera *Schizosaccharomyces, Issatchenkia, Kluyveromyces, Yarrowia, Pichia, Candida, Hansenula,* or *Saccharomyces.* In some embodiments, the host cell may be *Saccharomyces cerevisiae, Schizosaccharomyces pombe, Kluyveromyces lactis, Kluyveromyces thermotolerans, Kluyveromyces marxianus, Candida glabrata, Candida albicans, Pichia stipitis,* or *Yarrowia lipolytica.* In some embodiments, the host cell may be a yeast host cell. In some embodiments, the host cell is a member of the genera *Saccharomyces*. In some embodiments, the host cell may be *Kluyveromyces lactis, Candida glabrata* or *Schizosaccharomyces pombe. Saccharomyces cerevisiae* yeast are known in the art and are available from a variety of sources, including, but not limited to, American Type Culture Collection (Rockville, Md.), Centraalbureau voor Schimmelcultures (CBS) Fungal Biodiversity Centre, LeSaffre, Gert Strand AB, Ferm Solutions, North American Bioproducts, Martrex, and Lallemand. *Saccharomyces cerevisiae* include, but are not limited to, BY4741, CEN.PK 113-7D, Ethanol Red® yeast, Ferm Pro™ yeast, Bio-Ferm® XR yeast, Gert Strand Prestige Batch Turbo alcohol yeast, Gert Strand Pot Distillers yeast, Gert Strand Distillers Turbo yeast, FerMax™ Green yeast, FerMax™ Gold yeast, Thermosacc® yeast, BG-1, PE-2, CAT-1, CBS7959, CBS7960, and CBS7961.

"PNY860" refers to a strain derived from *Saccharomyces cerevisiae* which has been deposited under the Budapest Treaty on Jul. 21, 2011 at the American Type Culture Collection, Patent Depository 10801 University Boulevard, Manassas, Va. 20110-2209 and has the patent deposit designation PTA-12007.

In some embodiments, the isobutanologen may be a derivative of PNY860. In some embodiments, the butanologen may be a haploid derivative of strain PNY860. In some embodiments, the butanologen may be a non-sporulating derivative of PNY860. In some embodiments, the butanologen may be a non-mating derivative of PNY860.

In some embodiments, the butanologen expresses an engineered butanol biosynthetic pathway. In some embodiments, the butanologen is an isobutanologen expressing an engineered isobutanol biosynthetic pathway. In some embodiments, the butanologen expresses an engineered 1-butanol biosynthetic pathway. In some embodiments, the butanologen expresses an engineered 2-butanol biosynthetic pathway. In some embodiments, the butanologen expresses an engineered 2-butanone biosynthetic pathway.

Carbon Substrates

Suitable carbon substrates may include, but are not limited to, monosaccharides such as fructose or glucose; oligosaccharides such as lactose, maltose, galactose, or sucrose; polysaccharides such as starch or cellulose; and mixtures thereof, and unpurified mixtures from renewable feedstocks such as cheese whey permeate, cornsteep liquor, sugar beet molasses, and barley malt. Other carbon substrates may include ethanol, lactate, succinate, or glycerol.

"Sugar" includes monosaccharides such as fructose or glucose; oligosaccharides such as lactose, maltose, galactose, or sucrose; polysaccharides such as starch or cellulose; C5 sugars such as xylose and arabinose; and mixtures thereof.

Additionally, the carbon substrate may also be one-carbon substrates such as carbon dioxide or methanol for which metabolic conversion into key biochemical intermediates has been demonstrated. In addition to one and two carbon substrates, methylotrophic organisms are also known to utilize a number of other carbon containing compounds such as methylamine, glucosamine, and a variety of amino acids for metabolic activity. For example, methylotrophic yeasts are known to utilize the carbon from methylamine to form trehalose or glycerol (Bellion, et al., *Microb. Growth Cl Compd.*, [Int. Symp.], 7th (1993), 415-32, Editor(s): Murrell, J. Collin; Kelly, Don P. Publisher: Intercept, Andover, UK). Similarly, various species of *Candida* will metabolize alanine or oleic acid (Sulter, et al., Arch. Microbiol. 153: 485-489, 1990). Hence, it is contemplated that the source of carbon utilized in the present invention may encompass a wide variety of carbon containing substrates and will only be limited by the choice of organism.

Although it is contemplated that the carbon substrates described herein and mixtures thereof are suitable in the present invention, in some embodiments, the carbon substrates may be glucose, fructose, and sucrose, or mixtures of these with C5 sugars such as xylose and arabinose for yeasts cells modified to use C5 sugars. Sucrose may be derived from renewable sugar sources such as sugar cane, sugar beets, cassava, sweet sorghum, and mixtures thereof. Glucose and dextrose may be derived from renewable grain sources through saccharification of starch based feedstocks including grains such as corn, wheat, rye, barley, oats, and mixtures thereof. In addition, fermentable sugars may be derived from renewable cellulosic or lignocellulosic biomass through processes of pretreatment and saccharification, as described, for example, in U.S. Patent Application Publication No. 2007/0031918, the entire contents of which are herein incorporated by reference. Biomass includes materials comprising cellulose, and optionally further comprising hemicellulose, lignin, starch, oligosaccharides, and/or monosaccharides. Biomass may also comprise additional components such as protein and/or lipid. Biomass may be derived from a single source or biomass may comprise a mixture derived from more than one source; for example, biomass may comprise a mixture of corn cobs and corn stover, or a mixture of grass and leaves. Biomass includes, but is not limited to, bioenergy crops, agricultural residues, municipal solid waste, industrial solid waste, sludge from paper manufacture, yard waste, wood and forestry waste. Examples of biomass include, but are not limited to, corn grain, corn cobs, crop residues such as corn husks, corn stover, grasses, wheat, wheat straw, barley, barley straw, hay, rice straw, switchgrass, waste paper, sugar cane bagasse, sorghum, soy, components obtained from milling of grains, trees, branches, roots, leaves, wood chips, sawdust, shrubs and bushes, vegetables, fruits, flowers, animal manure, and mixtures thereof.

In some embodiments, the carbon substrate may be glucose derived from corn. In some embodiments, the carbon substrate may be glucose derived from wheat. In some embodiments, the carbon substrate may be sucrose derived from sugar cane.

In addition to an appropriate carbon source, fermentation media may contain suitable minerals, salts, cofactors, buffers, and other components, known to those skilled in the art, suitable for the growth of the cultures and promotion of an enzymatic pathway described herein.

Fermentation Conditions

Typically, cells are grown at a temperature in the range of about 20° C. to about 40° C. in an appropriate medium. Suitable growth media in the present invention include common commercially prepared media such as Sabouraud Dextrose (SD) broth, Yeast Medium (YM) broth, or broth that includes yeast nitrogen base, ammonium sulfate, and dextrose (as the carbon/energy source) or YPD Medium, a blend of peptone, yeast extract, and dextrose in optimal proportions for growing most *Saccharomyces cerevisiae* strains. Other defined or synthetic growth media may also be used, and the appropriate medium for growth of the particular microorganism will be known by one skilled in the art of microbiology or fermentation science. The use of agents known to modulate catabolite repression directly or indirectly, for example, cyclic adenosine 2':3'-monophosphate, may also be incorporated into the fermentation medium.

Suitable pH ranges for the fermentation may be from about pH 5.0 to about pH 9.0. In some embodiments, about pH 6.0 to about pH 8.0 may be used for the initial condition. Suitable pH ranges for the fermentation of yeast are typically from about pH 3.0 to about pH 9.0. In some embodiments, about pH 5.0 to about pH 8.0 may be used for the initial condition. Suitable pH ranges for the fermentation of other microorganisms are from about pH 3.0 to about pH 7.5. In some embodiments, about pH 4.5 to about pH 6.5 may be used for the initial condition.

Fermentations may be performed under aerobic or anaerobic conditions. In some embodiments, anaerobic or microaerobic conditions are used for fermentations.

Industrial Batch and Continuous Fermentations

Isobutanol, or other products, may be produced using a batch method of fermentation. A classical batch fermentation is a closed system where the composition of the medium is set at the beginning of the fermentation and not subject to artificial alterations during the fermentation. A variation on the standard batch system is the fed-batch system. Fed-batch fermentation processes are also suitable in the present invention and comprise a typical batch system with the exception that the substrate is added in increments as the fermentation progresses. Fed-batch systems are useful when catabolite repression is apt to inhibit the metabolism of the cells and where it is desirable to have limited amounts of substrate in the media. Batch and fed-batch fermentations are common and well known in the art and examples may be found in Thomas D. Brock in *Biotechnology: A Textbook of Industrial Microbiology*, Second Edition (1989) Sinauer Associates, Inc., Sunderland, Mass., or Deshpande, Appl. Biochem. Biotechnol. 36:227, 1992.

Isobutanol, or other products, may also be produced using continuous fermentation methods. Continuous fermentation is an open system where a defined fermentation medium is added continuously to a bioreactor and an equal amount of conditioned media is removed simultaneously for processing. Continuous fermentation generally maintains the cultures at a constant high density where cells are primarily in log phase growth. Continuous fermentation allows for the modulation of one factor or any number of factors that affect cell growth or end product concentration. Methods of modulating nutrients and growth factors for continuous fermentation processes as well as techniques for maximizing the rate of product formation are well known in the art of industrial microbiology and a variety of methods are detailed by Brock, supra.

It is contemplated that the production of isobutanol, or other products, may be practiced using batch, fed-batch, or continuous processes and that any known mode of fermentation would be suitable. Additionally, it is contemplated that cells may be immobilized on a substrate as whole cell catalysts and subjected to fermentation conditions for isobutanol production.

Methods for Isobutanol Isolation from the Fermentation Medium

Bioproduced isobutanol may be isolated from the fermentation medium using methods known in the art, for example, ABE fermentations (see, e.g., Durre, Appl. Microbiol. Biotechnol. 49:639-648, 1998, Groot, et al., Process. Biochem. 27:61-75, 1992, and references therein). For example, solids may be removed from the fermentation medium by centrifugation, filtration, decantation, or the like (see, e.g., U.S. Patent Application Publication No. 2012/0164302, the entire contents of which are herein incorporated by reference). Isobutanol may be isolated from the fermentation medium using methods such as distillation, azeotropic distillation, liquid-liquid extraction, adsorption, gas stripping, membrane evaporation, or pervaporation.

Because isobutanol forms a low boiling point, azeotropic mixture with water, distillation may be used to separate the mixture up to its azeotropic composition. Distillation may be used in combination with another separation method to obtain separation of the azeotrope. Methods that may be used in combination with distillation to isolate and purify isobutanol include, but are not limited to, decantation, liquid-liquid extraction, adsorption, and membrane-based techniques. Additionally, isobutanol may be isolated using azeotropic distillation using an entrainer (see, e.g., Doherty and Malone, *Conceptual Design of Distillation Systems*, McGraw Hill, N.Y., 2001).

The isobutanol-water mixture forms a heterogeneous azeotrope so that distillation may be used in combination with decantation to isolate and purify isobutanol. In this method, isobutanol-containing fermentation broth is distilled to near the azeotropic composition. Then, the azeotropic mixture is condensed, and isobutanol is separated from the fermentation medium by decantation. The decanted aqueous phase may be returned to the first distillation column as reflux. The isobutanol-rich decanted organic phase may be further purified by distillation in a second distillation column. Examples of distillation methods are described in U.S. Patent Application Publication No. 2011/0162953, U.S. Patent Application Publication No. 2011/0162954; U.S. Patent Application Publication No. 2011/0288345; and U.S. Patent Application Publication No. 2011/0288344; the entire contents of which are herein incorporated by reference.

Isobutanol may also be isolated from the fermentation medium using liquid-liquid extraction in combination with distillation. In this method, isobutanol is extracted from the fermentation broth using liquid-liquid extraction with a suitable solvent. The isobutanol-containing organic phase is then distilled to separate isobutanol from the solvent.

Distillation in combination with adsorption may also be used to isolate isobutanol from the fermentation medium. In this method, the fermentation broth containing isobutanol is distilled to near the azeotropic composition and then the remaining water is removed by use of an adsorbent, such as molecular sieves (Aden, et al., *Lignocellulosic Biomass to Ethanol Process Design and Economics Utilizing Co-Current Dilute Acid Prehydrolysis and Enzymatic Hydrolysis for Corn Stover*, Report NREL/TP-510-32438, National Renewable Energy Laboratory, June 2002).

Additionally, distillation in combination with pervaporation may be used to isolate and purify isobutanol from the fermentation medium. In this method, the fermentation broth containing isobutanol is distilled to near the azeotropic composition, and then the remaining water is removed by pervaporation through a hydrophilic membrane (Guo, et al., J. Membr. Sci. 245:199-210, 2004).

In situ product removal (ISPR) (also referred to as extractive fermentation) may be used to remove isobutanol (or other fermentative alcohol) from the fermentation vessel as it is produced, thereby allowing the microorganism to produce isobutanol at high yields. One method for ISPR for removing fermentative alcohol that has been described in the art is liquid-liquid extraction. In general, with regard to isobutanol fermentation, for example, the fermentation medium, which includes the microorganism, is contacted with an organic extractant at a time before the isobutanol concentration reaches a toxic level. The organic extractant and the fermentation medium form a biphasic mixture. Isobutanol partitions into the organic extractant phase, decreasing the concentration in the aqueous phase containing the microorganism, thereby limiting the exposure of the microorganism to the inhibitory isobutanol.

Liquid-liquid extraction may be performed, for example, according to the processes described in U.S. Patent Application Publication No. 2009/0305370, the disclosure of which is hereby incorporated in its entirety. U.S. Patent Application Publication No. 2009/0305370 describes methods for producing and recovering isobutanol from a fermentation broth using liquid-liquid extraction, the methods comprising the step of contacting the fermentation broth with a water immiscible extractant to form a two-phase mixture comprising an aqueous phase and an organic phase. Typically, the extractant may be an organic extractant selected from the group consisting of saturated, mono-unsaturated, poly-unsaturated (and mixtures thereof) $C_{12}$ to $C_{22}$ fatty alcohols, $C_{12}$ to $C_{22}$ fatty acids, esters of $C_{12}$ to $C_{22}$ fatty acids, $C_{12}$ to $C_{22}$ fatty aldehydes, and mixtures thereof. The extractant(s) for ISPR may be non-alcohol extractants. The ISPR extractant may be an exogenous organic extractant such as oleyl alcohol, behenyl alcohol, cetyl alcohol, lauryl alcohol, myristyl alcohol, stearyl alcohol, alkyl alkanols, 1-undecanol, oleic acid, lauric acid, myristic acid, stearic acid, methyl myristate, methyl oleate, undecanal, lauric aldehyde, 20-methylundecanal, trioctyl phosphine oxide, and mixtures thereof.

In some embodiments, an ester may be formed by contacting the alcohol in a fermentation medium with an organic acid (e.g., fatty acids) and a catalyst capable of esterifying the alcohol with the organic acid. In some embodiments, the organic acid may serve as an ISPR extractant into which the alcohol esters partition. The organic acid may be supplied to the fermentation vessel and/or derived from the biomass supplying fermentable carbon fed to the fermentation vessel. Lipids present in the feedstock may be catalytically hydrolyzed to organic acid, and the same catalyst (e.g., enzymes) can esterify the organic acid with the alcohol. The catalyst may be supplied to the feedstock prior to fermentation, or may be supplied to the fermentation vessel before or contemporaneously with the supplying of the feedstock. When the catalyst is supplied to the fermentation vessel, alcohol esters may be obtained by hydrolysis of the lipids into organic acid and substantially simultaneous esterification of the organic acid with isobutanol present in the fermentation vessel. Organic acid and/or native oil not derived from the feedstock may also be fed to the fermentation vessel, with the native oil being hydrolyzed into organic acid. Any organic acid not esterified with the alcohol may serve as part of the ISPR extractant. The extractant containing alcohol esters may be separated from the fermentation medium, and the alcohol can be recovered from the extractant. The extractant may be recycled to the fermentation vessel. Thus, in the case of isobutanol production, for example, the conversion of isobutanol to an ester reduces the free isobutanol concentration in the fermentation medium, shielding the microorganism from the toxic effect of increasing isobutanol concentration. In addition, unfractionated grain may be used as feedstock without separation of lipids therein, since the lipids can be catalytically hydrolyzed to organic acid, thereby decreasing the rate of build-up of lipids in the ISPR extractant. Other isobutanol product recovery and/or ISPR methods may be employed, including those described in U.S. Patent Application Publication No. 2009/0305370; U.S. Patent Application Publication No. 2011/0097773; U.S. Patent Application Publication No. 2012/0156738; the entire contents of which are herein incorporated by reference.

In situ product removal may be carried out in a batch mode or a continuous mode. In a continuous mode of in situ product removal, product is continually removed from the reactor. In a batchwise mode of in situ product removal, a volume of organic extractant is added to the fermentation vessel and the extractant is not removed during the process. For in situ product removal, the organic extractant may contact the fermentation medium at the start of the fermentation forming a biphasic fermentation medium. Alternatively, the organic extractant may contact the fermentation medium after the microorganism has achieved a desired amount of growth, which may be determined by measuring the optical density of the culture. Further, the organic extractant may contact the fermentation medium at a time at which the product level in the fermentation medium reaches a preselected level. In the case of isobutanol production according to some embodiments of the present invention, the organic acid extractant may contact the fermentation medium at a time before the isobutanol concentration reaches a toxic level, so as to esterify isobutanol with the organic acid to produce isobutanol esters and consequently reduce the concentration of isobutanol in the fermentation vessel. The ester-containing organic phase may then be removed from the fermentation vessel (and separated from the fermentation broth which constitutes the aqueous phase) after a desired effective titer of the isobutanol esters is achieved. In some embodiments, the ester-containing organic phase is separated from the aqueous phase after fermentation of the available fermentable sugar in the fermentation vessel is substantially complete.

Isobutanol titer in any phase may be determined by methods known in the art, such as via high performance liquid chromatography (HPLC) or gas chromatography, as described, for example in U.S. Patent Application Publication No. 2009/0305370, which is incorporated herein by reference.

EXAMPLES

The present invention is further defined in the following Examples. It should be understood that these Examples, while indicating embodiments of the invention, are given by way of illustration only. From the description herein and these Examples, one skilled in the art can ascertain the essential characteristics of this invention, and without departing from the spirit and scope thereof, can make various changes and modifications of the invention to adapt it to various uses and conditions.

General Methods

Standard recombinant DNA and molecular cloning techniques used in the Examples are well known in the art and are described by Sambrook, et al. (Sambrook, J., Fritsch, E. F. and Maniatis, T., Molecular Cloning: A Laboratory Manual; Cold Spring Harbor Laboratory Press, Cold Spring Harbor, 1989) and by Ausubel, et al. (Ausubel, et al., Current Protocols in Molecular Biology, pub. by Greene Publishing Assoc. and Wiley-Interscience, 1987).

Materials and methods suitable for the maintenance and growth of bacterial cultures are well known in the art. Techniques suitable for use in the following examples may be found as set out in Manual of Methods for General Bacteriology (Phillipp, et al., eds., American Society for Microbiology, Washington, D.C., 1994) or by Thomas D. Brock in (Brock, Biotechnology: A Textbook of Industrial Microbiology, Second Edition, Sinauer Associates, Inc., Sunderland, Mass., 1989). All reagents, restriction enzymes, and materials used for the growth and maintenance of bacterial cells were obtained from Sigma-Aldrich Chemicals (St. Louis, Mo.), BD Diagnostic Systems (Sparks, Md.), Invitrogen (Carlsbad, Calif.), HiMedia (Mumbai, India), SD Fine chemicals (India), or Takara Bio Inc. (Shiga, Japan), unless otherwise specified. Yeast strains and vectors were obtained from American Type Culture Collection (ATCC).

The meaning of abbreviations is as follows: "sec" means second(s), "min" means minute(s), "h" means hour(s), "nm" means nanometers, "uL" means microliter(s), "mL" means milliliter(s), "mg/mL" means milligram per milliliter, "L" means liter(s), "nm" means nanometers, "mM" means millimolar, "M" means molar, "mmol" means millimole(s), "μmole" means micromole(s), "kg" means kilogram, "g" means gram(s), "μg" means microgram(s) "ng" means nanogram(s), "PCR" means polymerase chain reaction, "ORF" means open reading frame, "OD" means optical density, "$OD_{600}$" means the optical density measured at a wavelength of 600 nm, "kDa" means kilodaltons, "g" can also mean the gravitation constant, "bp" means base pair(s), "kbp" means kilobase pair(s), "kb" means kilobase, "%" means percent, "% w/v" means weight/volume percent, "% v/v" means volume/volume percent, "HPLC" means high performance liquid chromatography, "g/L" means gram per liter, "μg/L" means microgram per liter, "ng/μL" means nanogram per microliter, "μmol/μL" means picomol per microliter, "rpm" means rotation per minute, "μmol/min/mg" means micromole per minute per milligram, "w/v" means weight per volume, "v/v" means volume per volume, and "CFU/mL" means colony-forming units per milliliter.

Example 1

Construction of a Randomly Mutated Library of YAP1 Gene

The *Saccharomyces cerevisiae* strain BY4741 (ATCC® No. 201388™; MATa his3Δ leu2Δ met15Δ ura3Δ) was used as a DNA template. An error-prone PCR (epPCR) library was made as following:
Amplification of Wild-Type YAP1 from Genomic DNA of *Saccharomyces cerevisiae* BY4741

Genomic DNA of *Saccharomyces cerevisiae* strain BY4741 (uracil and histidine auxotroph) was prepared from an overnight grown culture using Gentra® Puregene® Yeast/Bact. kit (Qiagen, Valencia, Calif.). The genomic DNA was used to amplify the ORF of YAP1 gene (SEQ ID NO: 2) using Phusion® High Fidelity PCR Master Mix (New England BioLabs Inc.; Ipswich, Mass.) using primers YAP1-F-XbaI-EcoRI and YAP-R-XhoI (SEQ ID NOs: 167 and 168). The PCR product was purified using QIAquick® PCR Purification Kit (Qiagen, Valencia, Calif.).
Error-Prone PCR (epPCR)

Approximately 0.1-0.5 mg purified PCR products were used as template for generating epPCR products with GeneMorph® II Random Mutagenesis Kit (Stratagene Corporation, La Jolla, Calif.). PCR was performed for 20-22 cycles in multiple tubes; epPCR products were purified using QIAquick® PCR Purification Kit (Qiagen, Valencia, Calif.).
Construction of Randomly Mutated YAP1 Library in p416 TEF Shuttle Vector Purified epPCR products were restricted using XbaI and XhoI restriction enzymes (New England BioLabs Inc.; Ipswich, Mass.), purified using QIAquick® PCR Purification Kit (Qiagen, Valencia, Calif.), and cloned into linear p416 TEF vector (ATCC® No. 87368™) (SEQ ID NO: 169). Purified epPCR product (100-200 μg), 100-150 μg of vector, and ligation buffer containing 5 units of T4 DNA ligase (Promega, Madison, Wis.) were combined, and the reaction mix was incubated overnight at 16° C. and transformed into *E. coli* CB5α (Chromas Biotech, Bangalore, India) competent cells. Transformants were selected on Luria-Bartani (LB) agar plates containing 100 μg/mL ampicillin. A total of $10^7$ numbers of *E. coli* colonies were pooled for plasmid isolation.
Construction of YAP1 Yeast Library Using *Saccharomyces cerevisiae* BY4741

Plasmids were extracted from transformants using QIAGEN® Plasmid Mini Kit (Qiagen, Valencia, Calif.) generating a plasmid library. The purified plasmid library was then transformed into *Saccharomyces cerevisiae* BY4741 competent cells using Frozen-EZ Yeast Transformation II Kit™ (Zymo Research Corporation, Irvine, Calif.). Yeast transformants were selected in uracil-deficient minimal medium (1× yeast nitrogen base without amino acids; 80 mg/L each of leucine, histidine, and methionine amino acid mix without uracil, 20 g/L glucose as carbon source) after 48-72 hours of incubation at 30° C. Cells were recovered from plates by washing using the same uracil-deficient minimal medium and preserved as glycerol stock at −80° C. for further use. A total of $10^8$ numbers of colonies were pooled and preserved as "YAP1-mut yeast library."

Example 2

Screening of Isobutanol Tolerant Clones in BY4741:YAP1-Mut Colonies

The YAP1-mut yeast library was screened for isobutanol tolerant strains. The library was suspended in uracil-deficient minimal medium (1× yeast nitrogen base without amino acid; 80 mg/L each of leucine, histidine, and methionine amino acid mix without uracil, 20 g/L glucose as carbon source) containing either 20 or 24 g/L isobutanol in flasks. The flasks were agitated at 150 rpm and at 30° C. Every 24 h, the cultures were diluted 1:1 using fresh uracil-deficient minimal medium containing 20 or 24 g/L isobutanol. After 4 repeated transfers/dilutions in 20 or 24 g/L isobutanol containing media, the culture was plated on uracil-deficient agar plates containing 20 or 24 g/L isobutanol. Single colonies that appeared after 72-96 h of incubation were suspended in 96-well deep well plates (same medium without isobutanol) which served as the master plate for subsequent analysis. After 24 h of incubation, 0.01 mL of each culture from the 96-well master plates was inoculated into minimal medium containing either 20 or 24 g/L isobutanol in 96-well test plates. Test plates were incubated at 30° C. After 24 h or 48 h of incubation, 5 μL culture from test plates were spotted on uracil-deficient agar plates without isobutanol. Colonies that survived 24 or 48 h exposure in 20 or 24 g/L isobutanol were purified on agar plates containing isobutanol and processed further for identification of mutations in the YAP1 ORF cloned in shuttle vector p416 TEF (SEQ ID NO: 169). For this purpose, plasmids were isolated from selected yeast clones using Zymoprep™ Yeast Plasmid Miniprep Kit (Zymo Research Corporation, Irvine, Calif.) and transformed into *E. coli* CB5α strain. Transformants were selected and purified on LB agar plates containing 100 μg/L ampicillin. Plasmids extracted from purified *E. coli* clones were restricted using XbaI and XhoI to verify the presence of insert, and sequenced using primers p416 Forward (SEQ ID NO: 170), p416 Reverse (SEQ ID NO: 171), YAP1306F (SEQ ID NO: 172), YAP1769R (SEQ ID NO: 173), YAP1961F (SEQ ID NO: 174), YAP11368R (SEQ ID NO: 175), YAP1488R (SEQ ID NO: 176), and YAP11647R (SEQ ID NO: 177).

The sequences were aligned using Vector NTI® software (Life Technologies Corporation, Grand Island, N.Y.) and were subjected to multiple sequence alignments using ALIGNX tool of Vector NTI® software. Ten variants of the YAP1 gene ("YAP1 variants") were identified. The number of nucleotide and amino acid changes of each variant are shown in Table 8, and the amino acid changes are shown in Table 9. The position of amino acid changes are presented as numbers corresponding to the wild-type Yap1. Only the position of the amino acid variation corresponding to wild-type (numbers) Yap1 is shown.

TABLE 8

| Variant | Number of Nucleotides Changed | Number of Amino Acids Changed |
|---|---|---|
| B5-1 | 3 | 2 |
| B5-4 | 5 | 3 |
| B8-1 | 1 | 1 |
| B8-4 | 2 | 2 |
| C5-2 | 8 | 4 |
| C5-3 | 5 | 3 |
| D8-1 | 1 | 0 |
| D8-4 | 1 | 1 |
| E5-4 | 5 | 3 |
| F8-1 | 5 | 3 |

TABLE 9

| YAP1 variants | Location of amino acid changes of YAP1 WT ORF | | | | | | | | | | | | | | | | | | |
|---|---|---|---|---|---|---|---|---|---|---|---|---|---|---|---|---|---|---|---|
| | 80 | 132 | 168 | 237 | 254 | 257 | 297 | 302 | 367 | 404 | 411 | 444 | 487 | 498 | 499 | 548 | 584 | 617 | 636 |
| B5-1 | . | . | . | . | V | . | . | . | . | A | . | . | . | . | . | . | . | . | . |
| B5-4 | V | G | . | . | . | . | . | . | . | . | . | C | . | . | . | . | . | . | . |
| B8-1 | . | . | G | . | . | . | . | . | . | . | . | . | . | . | . | . | . | . | . |
| B8-4 | . | . | . | . | . | . | . | . | . | . | . | . | . | K | . | . | . | N | . |
| C5-2 | . | . | . | F | . | . | K | . | I | . | . | . | . | . | L | . | . | . | . |
| C5-3 | . | . | . | . | . | . | . | . | . | . | S | . | . | . | . | . | G | . | V |
| D8-1 | . | . | . | . | . | . | . | . | . | . | . | . | . | . | . | . | . | . | . |
| D8-4 | . | . | . | . | . | S | . | . | . | . | . | . | . | . | . | . | . | . | . |
| E5-4 | . | . | . | . | . | . | . | . | L | . | . | . | T | . | R | . | . | . | . |
| F8-1 | . | . | . | . | . | . | . | . | L | . | . | . | T | . | R | . | . | . | . |
| Wild-type | A | R | D | L | M | L | E | F | T | T | N | G | E | M | F | K | D | D | I |

Alignments of nucleotide sequences of wild-type and YAP1 variants showed 1-8 nucleotide point mutations in the YAP1 variants, resulting in 0-4 amino acids changes in the coding region of the Yap1. YAP1 variants E5-4 and F8-1 (SEQ ID NOs: 20 and 27) have similar mutations in YAP1 ORF. YAP1 variants D8-1 (SEQ ID NO: 178) has a single nucleotide substitution; however, there was no change in the amino acid sequence (silent mutation). The YAP1 variants C5-2 (SEQ ID NO: 23) has 8 nucleotide substitutions in YAP1 gene. The majority of the clones that showed isobutanol tolerance have more than 2 mutations in YAP1 gene ORF.

Example 3

Glucose Assimilation Test

Cells of *Saccharomyces cerevisiae* BY4741 transformed with plasmid p416-TEF (vector control), plasmid overexpressing wild-type YAP1 gene, or YAP1 variants cloned in p416-TEF (Table 5) were used in this study. Cells were grown in uracil-deficient medium (1× yeast nitrogen base without amino acid; 80 mg/l each of leucine, histidine, and methionine amino acid mix without uracil, 20 g/L glucose as carbon source) and suspended to OD=10 in the same medium containing 22 g/L isobutanol. The cultures were grown for 24 h at 30° C. with agitation at 220 rpm. Residual glucose content of culture supernatant was measured at 0 h and 24 h using HPLC, and glucose consumed was calculated as the difference between the residual glucose in the culture at 0 h and 24 hr (Δ of residual glucose of 0 and 24 h). Results are shown in Table 10. Data shown is glucose consumption (g/L) and is average of three independent replicates.

TABLE 10

| Controls | | Variants of YAP1 gene overexpressed in *Saccharomyces cerevisiae* BY4741* | | | | | | | | | |
|---|---|---|---|---|---|---|---|---|---|---|---|
| p416 vector | WT YAP1 | B5-1 | C5-2 | B8-4 | C5-3 | E5-4 | B8-1 | D8-1 | D8-4 | F8-1 | B5-4 |
| 2.5 | 3 | 3 | 4.5 | 3 | 4.5 | 4 | 1 | 5 | 4 | 4 | 1 |

*Data shown is glucose consumption (g/L)

Cells overexpressing YAP1 variants such as C5-2 (SEQ ID NO: 23), C5-3 (SEQ ID NO: 24), D8-4 (SEQ ID NO: 25), E5-4 (SEQ ID NO: 26), and F8-1 (SEQ ID NO: 27) consumed more glucose compared to controls (Table 10). Yeast cells overexpressing YAP1 variants B5-1 (SEQ ID NO: 19), B8-1 (SEQ ID NO: 21), B8-4 (SEQ ID NO: 22), and B5-4 (SEQ ID NO: 20) consumed either less or equal amount of glucose as compared to wild-type YAP1. Since the wild-type YAP1 gene was not knocked out in the YAP1 variants, YAP1 variants were expressing the wild-type chromosomal YAP1 and overexpressing mutated YAP1 from plasmid.

Example 4

Isobutanol Tolerance

Cells of *Saccharomyces cerevisiae* BY4741 expressing wild-type YAP1 or YAP1 variants were grown in uracil-deficient medium (1× yeast nitrogen base without amino acid; 80 mg/L each of leucine, histidine, and methionine amino acid mix without uracil, 20 g/L glucose as carbon source) at 30° C. for 18 h at 200 rpm. The cells were diluted to 2-5×10$^7$ CFU/mL and suspended in the same medium containing 25 g/L isobutanol. Cultures were incubated at 30° C. for 24 h with agitation at 200 rpm. Viable cell count (expressed as $\log_{10}$ number) was performed at 0 h and 24 h of incubation in isobutanol-containing medium, and reduction of viable cell count ($\log_{10}$) was calculated and expressed as percentage of viability. Results are shown in Table 11.

TABLE 11

| | Controls | | Variants of YAP1 Gene Overexpressed in Saccharomyces cerevisiae BY4741 | | | | | | | | | |
|---|---|---|---|---|---|---|---|---|---|---|---|---|
| CFU*/mL ($\log_{10}$) | p416 vector | WT YAP1 | B5-1 | C5-2 | B8-4 | C5-3 | E5-4 | B8-1 | D8-1 | D8-4 | F8-1 | B5-4 |
| $\log_{10}$ cells at 0 h | 7.6 | 7.3 | 7.7 | 7.3 | 7.0 | 7.5 | 7.5 | 7.0 | 7.5 | 7.6 | 7.7 | 7.7 |
| $\log_{10}$ cells at 24 h | 3.3 | 4.6 | 4.6 | 5.0 | 3.3 | 5.6 | 4.0 | 4.5 | 4.0 | 5.3 | 4.3 | 4.6 |
| % cell viability | 43.4 | 63.0 | 59.8 | 68.5 | 47 | 75 | 53.5 | 64 | 53.5 | 69.7 | 56 | 60 |

Cells overexpressing YAP1 variants E5-4, F8-1, D8-1, C5-2, C5-3, D8-4, B5-1, B8-1, B8-4, and B5-4 showed improved cell viability in 25 g/L isobutanol. Cells overexpressing YAP1 variants C5-2, C5-3, and D8-4 showed 68-74% viability in 25 g/L isobutanol, whereas the cell viability of the vector control was 43% (Table 11). Thus, overexpression of wild-type YAP1 and YAP1 variants improved cell viability in isobutanol by 10-31% over vector control.

Example 5

Construction of Strains for Isobutanol Production

The haploid strains (PNY891 MATa and PNY0894 MATα) were chosen as a host for isobutanol production. Gene deletion and integration were performed in the haploid strains to create a strain background suitable for isobutanol production. Chromosomal gene deletion was performed by homologous recombination with a PCR cassette containing homology upstream and downstream of the target gene, and either a G-418 resistance marker or URA3 gene for selection of transformants. For gene integration, the gene to be integrated was included in the PCR cassette. The selective marker recycle was achieved using either the Crelox system or a scarless deletion method (Akada, et al., Yeast 23: 399, 2006).

First, gene deletion (URA3, HIS3, PDC6, and PDC1) and integration (ilvD into the PDC1 site) were performed in the PNY891 MATa to generate PNY1703 (=MATa ura3Δ::loxP his3Δ::loxP pdc6Δ pdc1Δ::ilvD). Second, PNY1703 was mated with PNY0894 MATα to make a diploid. The resulting diploid was sporulated and then tetrad-dissected, and spore segregants were screened for growth phenotype on glucose and ethanol media, and genotype carrying ura3Δ:: loxP his3Δ::loxP pdc6Δ pdc1Δ::ilvD. Two mating type haploids, PNY1713 (=MATα ura3Δ::loxP his3Δ::loxP pdc6Δ pdc1Δ::ilvD) and PNY1714 (=MATa ura3Δ::loxP his3Δ:: loxP pdc6Δ pdc1Δ::ilvD) were isolated. Third, gene deletion (PDC5, FRA2, GPD2, BDH1, and YMR226c) and integration (kivD, ilvD, alsS, and ilvD-adh into the PDC5, FRA2, GPD2, and BDH1 sites, respectively) were performed in the PNY1714 strain background to construct PNY1758 (=MATa ura3Δ::loxP his3Δ::loxP pdc6Δ pdc1Δ::ilvD pdc5Δ::kivD(y) fra2Δ::UAS(PGK1)-FBA1p-ilvD(y)gpd2Δ::loxP71/66-FBA1p-alsS bdh1Δ::UAS(PGK1)-ENO2p-ilvD-ILV5p-adh ymr226cΔ).

URA3 Deletion

To delete the endogenous URA3 coding region, a deletion cassette was PCR-amplified from pLA54 (SEQ ID NO: 179) which contains a TEF1p-kanMX-TEF1t cassette flanked by loxP sites to allow homologous recombination in vivo and subsequent removal of the KanMX marker. PCR was performed using Phusion® DNA polymerase (New England BioLabs Inc., Ipswich, Mass.) and primers BK505 (SEQ ID NO: 180) and BK506 (SEQ ID NO: 181). The URA3 portion of each primer was derived from the 5' region 180 bp upstream of the URA3 ATG and 3' region 78 bp downstream of the coding region such that integration of the KanMX cassette results in replacement of the URA3 coding region. The PCR product was transformed into PNY891, a haploid strain, using standard genetic techniques (Methods in Yeast Genetics, 2005, Cold Spring Harbor Laboratory Press, Cold Spring Harbor, N.Y., pp. 201-202) and transformants were selected on rich media supplemented with 2% glucose and G-418 (Geneticin®, 100 µg/mL) at 30° C. Transformants were patched onto rich media supplemented with 2% glucose and replica plated onto synthetic complete media lacking uracil and supplemented with 2% glucose to identify uracil auxotrophs. These patches were screened by colony PCR with primers LA468 (SEQ ID NO: 182) and LA492 (SEQ ID NO: 183) to verify presence of the integration cassette. A URA3 mutant was obtained; NYLA96 (=MATa ura3Δ::loxP-kanMX-loxP).

HIS3 Deletion

To delete the endogenous HIS3 coding region, a deletion cassette was PCR-amplified from pLA33 (SEQ ID NO: 184) which contains a URA3p-URA3-URA3t cassette flanked by loxP sites to allow homologous recombination in vivo and subsequent removal of the URA3 marker. PCR was performed using Phusion® DNA polymerase (New England BioLabs Inc., Ipswich, Mass.) and primers 315 (SEQ ID NO: 185) and 316 (SEQ ID NO: 186). The HIS3 portion of each primer was derived from the 5' region 50 bp upstream of the HIS3 ATG and 3' region 50 bp downstream of the coding region such that integration of the URA3 cassette results in replacement of the HIS3 coding region. The PCR product was transformed into NYLA96 using standard genetic techniques (Methods in Yeast Genetics, 2005, Cold Spring Harbor Laboratory Press, Cold Spring Harbor, N.Y., pp. 201-202) with selection on synthetic complete media lacking uracil supplemented with 2% glucose at 30° C. Transformants were screened by colony PCR with primers 92 (SEQ ID NO: 187) and 346 (SEQ ID NO: 188) to verify presence of the integration cassette. The URA3 marker was recycled by transforming with pRS423::GAL1p-cre (SEQ ID NO: 189) and plated on synthetic complete media lacking histidine and supplemented with 2% glucose at 30° C. Transformants were plated on yeast extract+peptone (YP) agar plate supplemented with 0.5% galactose to induce expression of Cre recombinase. Marker removal was confirmed by patching colonies to synthetic complete media lacking uracil and supplemented with 2% glucose to verify absence of growth. Also, marker removal of the KanMX cassette, used to delete URA3, was confirmed by patching colonies to rich media supplemented with 2% glucose and G-418 (Geneticin®, 100 μg/mL) at 30° C. to verify absence of growth. The resulting URA3 and HIS3 deletion strain was named NYLA107 (=MATa ura3Δ::loxP his3Δ::loxP).

PDC6 Deletion

*Saccharomyces cerevisiae* has three PDC genes (PDC1, PDC5, PDC6), encoding three different isozymes of pyruvate decarboxylase. Pyruvate decarboxylase catalyzes the first step in ethanol fermentation, producing acetaldehyde from the pyruvate generated in glycolysis.

The PDC6 coding sequence was deleted by homologous recombination with a PCR cassette (A-B-U-C) containing homology upstream (fragment A) and downstream (fragment B) of the PDC6 coding region, a URA3 gene along with the promoter (250 bp upstream of the URA3 gene) and terminator (150 bp downstream of the URA3 gene) (fragment U) for selection of transformants, and the 3' region of the PDC6 coding region (fragment C), according to a scarless deletion method (Akada, et al., Yeast 23: 399, 2006). The four fragments (A, B, U, C) for the PCR cassette for the scarless PDC6 deletion were amplified from PNY891 genomic DNA as template using Phusion® High Fidelity PCR Master Mix (New England BioLabs Inc.; Ipswich, Mass.). PNY891 genomic DNA was prepared with a Gentra® Puregene® Yeast/Bact. kit (Qiagen, Valencia, Calif.). PDC6 Fragment A was amplified with primer oBP440 (SEQ ID NO: 190) and primer oBP441 (SEQ ID NO: 191), containing a 3' tail with homology to the 5' end of PDC6 Fragment B. PDC6 Fragment B was amplified with primer oBP442 (SEQ ID NO: 192), containing a 5' tail with homology to the 3' end of PDC6 Fragment A, and primer oBP443 (SEQ ID NO: 193), containing a 5' tail with homology to the 5' end of PDC6 Fragment U. PDC6 Fragment U was amplified with primer oBP444 (SEQ ID NO: 194), containing a 5' tail with homology to the 3' end of PDC6 Fragment B, and primer oBP445 (SEQ ID NO: 195), containing a 5' tail with homology to the 5' end of PDC6 Fragment C. PDC6 Fragment C was amplified with primer oBP446 (SEQ ID NO: 196), containing a 5' tail with homology to the 3' end of PDC6 Fragment U, and primer oBP447 (SEQ ID NO: 197). PCR products were purified with a PCR purification kit (Qiagen, Valencia, Calif.). PDC6 Fragment A-B was created by overlapping PCR by mixing PDC6 Fragment A and PDC6 Fragment B and amplifying with primers oBP440 (SEQ ID NO: 190) and oBP443 (SEQ ID NO: 193). PDC6 Fragment U-C was created by overlapping PCR by mixing PDC6 Fragment U and PDC6 Fragment C and amplifying with primers oBP444 (SEQ ID NO: 194) and oBP447 (SEQ ID NO: 197). The resulting PCR products were gel-purified on an agarose gel followed by a gel extraction kit (Qiagen, Valencia, Calif.). The PDC6 A-B-U-C cassette was created by overlapping PCR by mixing PDC6 Fragment A-B and PDC6 Fragment U-C and amplifying with primers oBP440 (SEQ ID NO: 190) and oBP447 (SEQ ID NO: 197). The PCR product was purified with a PCR purification kit (Qiagen, Valencia, Calif.).

Competent cells of NYLA107 were made and transformed with the PDC6 A-B-U-C PCR cassette using a Frozen-EZ Yeast Transformation II™ kit (Zymo Research Corporation, Irvine, Calif.). Transformation mixtures were plated on synthetic complete media lacking uracil supplemented with 2% glucose at 30° C. Transformants with a pdc6 knockout were screened for by PCR with primers oBP448 (SEQ ID NO: 198) and oBP449 (SEQ ID NO: 199) using genomic DNA prepared with a Gentra® Puregene® Yeast/Bact. kit (Qiagen, Valencia, Calif.). To remove the URA3 marker from the chromosome, a correct transformant was grown overnight in YPD and plated on synthetic complete medium containing 5-fluoro-orotic acid (0.1%) at 30° C. to select for isolates that lost the URA3 marker. The deletion and marker removal were confirmed by PCR and sequencing with primers oBP448 (SEQ ID NO: 198) and oBP449 (SEQ ID NO: 199) using genomic DNA prepared with a Gentra® Puregene® Yeast/Bact. kit (Qiagen, Valencia, Calif.). The absence of the PDC6 gene from the isolate was demonstrated by a negative PCR result using primers specific for the coding sequence of PDC6, oBP554 (SEQ ID NO: 200) and oBP555 (SEQ ID NO: 201). The correct isolate was selected as strain PNY1702 (=MATa ura3Δ::loxP his3Δ::loxP pdc6Δ).

PDC1 Deletion and ilvD Integration

The PDC1 coding region was deleted and replaced with the ilvD coding region from *Streptococcus mutans* ATCC® No. 700610™ by homologous recombination with a PCR cassette (A-ilvD-B-U-C) containing homology upstream (fragment A) and downstream (fragment B) of the PDC1 coding region, the ilvD coding region (fragment ilvD), a URA3 gene along with the promoter and terminator (fragment U) for selection of transformants, and the 3' region of the PDC1 coding region (fragment C). The A fragment followed by the ilvD coding region from *Streptococcus mutans* for the PCR cassette for the PDC1 deletion-ilvD integration was amplified using Phusion® High Fidelity PCR Master Mix (New England BioLabs Inc.; Ipswich, Mass.) and NYLA83 (described in U.S. Patent Application Publication No. 2011/0312043, the entire contents of which are herein incorporated by reference) genomic DNA as template, prepared with a Gentra® Puregene® Yeast/Bact. kit (Qiagen, Valencia, Calif.). PDC1 Fragment A-ilvD was amplified with primer oBP513 (SEQ ID NO: 202) and primer oBP515 (SEQ ID NO: 203), containing a 5' tail with homology to the 5' end of PDC1 Fragment B. The B, U, and C fragments for the PCR cassette for the PDC1 deletion-ilvD integration were amplified using Phusion® High Fidelity PCR Master Mix (New England BioLabs Inc.; Ipswich, Mass.) and PNY891 genomic DNA as template, prepared with a Gentra® Puregene® Yeast/Bact. kit (Qiagen, Valencia, Calif.). PDC1 Fragment B was amplified with primer oBP516 (SEQ ID NO: 204), containing a 5' tail with homology to the 3' end of PDC1 Fragment A-ilvD, and primer oBP517 (SEQ ID NO: 205), containing a 5' tail with homology to the 5' end of PDC1 Fragment U. PDC1 Fragment U was amplified with primer oBP518 (SEQ ID NO: 206), containing a 5' tail with homology to the 3' end of PDC1 Fragment B, and primer oBP519 (SEQ ID NO: 207), containing a 5' tail with homology to the 5' end of PDC1 Fragment C. The PDC1 Fragment C was amplified with primer oBP520 (SEQ ID NO: 208), containing a 5' tail with homology to the 3' end of PDC1 Fragment U, and primer oBP521 (SEQ ID NO: 209). PCR products were purified with a PCR purification kit (Qiagen, Valencia, Calif.). PDC1 Fragment A-ilvD-B was created by overlapping PCR by mixing PDC1 Fragment A-ilvD and PDC1 Fragment B and amplifying with primers oBP513 and oBP517. PDC1 Fragment U-C was created by overlapping PCR by mixing PDC1 Fragment U and PDC1 Fragment C and amplifying with primers oBP518 (SEQ ID NO: 206) and oBP521 (SEQ ID NO: 209). The resulting PCR products were gel-purified on an agarose gel followed by a gel extraction kit (Qiagen, Valencia, Calif.). The PDC1 A-ilvD-B-U-C cassette was created by overlapping PCR by mixing PDC1 Fragment A-ilvD-B and PDC1 Fragment U-C and amplifying with primers oBP513 (SEQ ID NO: 202) and oBP521 (SEQ ID NO: 209). The PCR product was purified with a PCR purification kit (Qiagen, Valencia, Calif.).

Competent cells of PNY1702 were made and transformed with the PDC1 A-ilvD-B-U-C PCR cassette using a Frozen-EZ Yeast Transformation II™ kit (Zymo Research Corporation, Irvine, Calif.). Transformation mixtures were plated on synthetic complete media lacking uracil supplemented with 2% glucose at 30 C. Transformants with a pdc1 knockout ilvD integration were screened for by PCR with primers oBP511 (SEQ ID NO: 210) and oBP512 (SEQ ID NO: 211) using genomic DNA prepared with a Gentra® Puregene® Yeast/Bact. kit (Qiagen, Valencia, Calif.). The absence of the PDC1 gene from the isolate was demonstrated by a negative PCR result using primers specific for the coding sequence of PDC1, oBP550 (SEQ ID NO: 212) and oBP551 (SEQ ID NO: 213). To remove the URA3 marker from the chromosome, a correct transformant was grown overnight in YPD and plated on synthetic complete medium containing 5-fluoro-orotic acid (0.1%) at 30° C. to select for isolates that lost the URA3 marker. The deletion of PDC1, integration of ilvD, and marker removal were confirmed by PCR with primers ilvDSm(1354F) (SEQ ID NO: 214) and oBP512 (SEQ ID NO: 211) and sequencing with primers ilvDSm(788R) (SEQ ID NO: 215) and ilvDSm (1354F) (SEQ ID NO: 214) using genomic DNA prepared with a Gentra® Puregene® Yeast/Bact. kit (Qiagen, Valencia, Calif.). The correct isolate was selected as strain PNY1703 (=MATa ura3Δ::loxP his3Δ::loxP pdc6Δ pdc1Δ:: ilvD).

PNY1703 MATa×PNY0894 MATα mating, sporulation, and tetrad dissection to isolate PNY1713 (=MATα ura3Δ:: loxP his3Δ::loxP pdc6Δ pdc1Δ::ilvD) and PNY1714 (=MATa ura3Δ::loxP his3Δ::loxP pdc6Δ pdc1Δ::ilvD)

Diploid (MATa/α) cells were created by crossing PNY1703 MATa and PNY0894 MATα on YPD at 30° C. overnight. Potential diploids were streaked onto an YPD plate and incubated at 30° C. for 4 days to isolate single colonies. To identify diploid, colony PCR (Huxley, et al., Trends Genet. 6:236, 1990) was carried out using Phusion® High Fidelity PCR Master Mix (New England BioLabs Inc.; Ipswich, Mass.) with three oligonucleotide primers, MAT1 (SEQ ID NO: 216) corresponding to a sequence at the right of and directed toward the MAT locus, MAT2 (SEQ ID NO: 217) corresponding to a sequence within the α-specific region located at MATα and HMLα, and MAT3 (SEQ ID NO: 218) corresponding to a sequence within the a-specific region located at MATa and HMRa. Diploid colonies were determined by yielding two PCR products, MATα-specific 404 bp and MATa-specific 544 bp. The resulting diploids were grown in pre-sporulation medium and then inoculated into sporulation medium (Codón, et al., Appl. Environ. Microbiol. 61:630, 1995). After 3 days, the sporulation efficiency was checked by microscope. Spores were digested with 0.05 mg/mL Zymolyase® (Zymo Research Corporation, Irvine, Calif.; using the procedure from Methods in Yeast Genetics, 2000, Cold Spring Harbor Laboratory Press, Cold Spring Harbor, N.Y.). Eight (8) plates of tetrads were dissected (18 tetrads per plate, totaling 144 tetrads, 576 spores) on YPD plates and placed at 30° C. for 4 days. To screen the spore progeny for genotype ura3Δ and his3Δ and growth phenotype on ethanol and glucose media, the spores on YPD plates were sequentially replica plated to 1) the synthetic complete (SC) media lacking uracil (ura) supplemented with 2% glucose, 2) SC lacking histidine (his) supplemented with 2% glucose, and then 3) SC supplemented with 0.5% ethanol media using a yeast replica plating apparatus (Corastyles, Hendersonville, N.C.). Spores that failed to grow on SC-ura and SC-his plates, but grew on SC+0.5% ethanol and YPD plates were selected and PCR-analyzed to determine their mating-type (Huxley, et al., Trends Genet. 6:236, 1990). To determine if the spores contain pdc1Δ::ilvD, the selected spores were checked by colony PCR using primers oBP512 (SEQ ID NO: 211) and ilvDSm(1354F) (SEQ ID NO: 214). Spores containing pdc1Δ::ilvD produce an expected PCR product of 962 bp, but those without the deletion produce no PCR product. The positive spores were then PCR-checked for the deletion of PDC6 using primers oBP448 (SEQ ID NO: 198) and oBP449 (SEQ ID NO: 199). The expected PCR sizes of the fragments were 1.3 kbp for cells containing the pdc6Δ and 2.9 kbp for cells containing the wild-type PDC6 gene. The correct isolates were selected for both mating types, and designated as PNY1713 (=MATα ura3Δ::loxP his3Δ::loxP pdc6Δ pdc1Δ::ilvD) and PNY1714 (=MATa ura3Δ::loxP his3Δ::loxP pdc6Δ pdc1Δ::ilvD).

PDC5 Deletion and kivD(y) Integration

The PDC5 coding region was deleted and replaced with the kivD coding region from *Lactococcus lactis* by homologous recombination with a PCR cassette (A-kivD(y)-B-U-C) containing homology upstream (fragment A) and downstream (fragment B) of the PDC5 coding region, the kivD(y) coding region (fragment kivD(y)), codon optimized for expression in *Saccharomyces cerevisiae*, a URA3 gene along with the promoter and terminator (fragment U) for selection of transformants, and the 3' region of the PDC5 coding region (fragment C).

PDC5 Fragment A was amplified from PNY891 genomic DNA as template using Phusion® High Fidelity PCR Master Mix (New England BioLabs Inc.; Ipswich, Mass.) with primer T-A(PDC5) (SEQ ID NO: 219) and primer B-A (kivD) (SEQ ID NO: 220), containing a 3' tail with homology to the 5' end of kivD(y). The coding sequence of kivD(y) was amplified from (SEQ ID NO: 221) as template with primer T-kivD(A) (SEQ ID NO: 222), containing a 5' tail with homology to the 3' end of PDC5 Fragment A, and primer B-kivD(B) (SEQ ID NO: 223), containing a 3' tail with homology to the 5' end of PDC5 Fragment B. PDC5 Fragment A-kivD(y) was created by overlapping PCR by mixing PDC5 Fragment A and kivD(y) and amplifying with primers T-A(PDC5) and B-A(kivD). PDC5 Fragment B was cloned into pUC19-URA3MCS to create the B-U portion of the PDC5 A-kivD(y)-B-U-C PCR cassette. The resulting plasmid was designated as pUC19-URA3-sadB-PDC5fragmentB (SEQ ID NO: 224). A plasmid pUC19-URA3-sadB-PDC5fragmentB was used as a template for amplification of PDC5 Fragment B-Fragment U using primers T-B(kivD) (SEQ ID NO: 225), containing a 5' tail with homology to the 3' end of kivD(y) Fragment, and oBP546 (SEQ ID NO: 226), containing a 3' tail with homology to the 5' end of PDC5 Fragment C. PDC5 Fragment C was amplified with primer oBP547 (SEQ ID NO: 227), containing a 5' tail with homology to the 3' end of PDC5 Fragment B-Fragment U, and primer oBP539 (SEQ ID NO: 228). PCR products were purified with a PCR purification kit (Qiagen, Valencia, Calif.). PDC5 Fragment B-Fragment U-Fragment C was created by overlapping PCR by mixing PDC5 Fragment B-Fragment U and PDC5 Fragment C and amplifying with primers T-B(kivD) (SEQ ID NO: 225) and oBP539 (SEQ ID NO: 228). The resulting PCR product was purified on an agarose gel followed by a gel extraction kit (Qiagen, Valencia, Calif.). The PDC5 A-kivD(y)-B-U-C cassette was created by overlapping PCR by mixing PDC5 Fragment A-kivD(y) Fragment and PDC5 Fragment B-Fragment U-PDC5 Fragment C and amplifying with primers T-A (PDC5) (SEQ ID NO: 219) and oBP539 (SEQ ID NO: 228). The PCR product was purified with a PCR purification kit (Qiagen, Valencia, Calif.).

Competent cells of PNY1714 were made and transformed with the PDC5 A-kivD(y)-B-U-C PCR cassette using a Frozen-EZ Yeast Transformation II™ kit (Zymo Research Corporation, Irvine, Calif.). Transformation mixtures were plated on synthetic complete media lacking uracil supplemented with 0.5% ethanol (no glucose) at 30° C. Transformants with a pdc5 knockout kivD integration were screened for by PCR with primers oBP540 (SEQ ID NO: 229) and kivD(652R) (SEQ ID NO: 230) using genomic DNA prepared with a Gentra® Puregene® Yeast/Bact. kit (Qiagen, Valencia, Calif.). The absence of the PDC5 gene from the isolate was demonstrated by a negative PCR result using primers specific for the coding sequence of PDC5, oBP552 (SEQ ID NO: 231) and oBP553 (SEQ ID NO: 232). To remove the URA3 marker from the chromosome, each correct transformant of both MATα and MATa strains was grown overnight in YPE (0.5% ethanol) and plated on synthetic complete medium supplemented with ethanol (no glucose) and containing 5-fluoro-orotic acid (0.1%) at 30° C. to select for isolates that lost the URA3 marker. The deletion of PDC5, integration of kivD(y), and marker removal were confirmed by PCR with primers oBP540 and oBP541 using genomic DNA prepared with a Gentra® Puregene® Yeast/Bact. kit (Qiagen, Valencia, Calif.). The correct integration of the kivD(y) coding region was confirmed by DNA sequence with primers, kivD(652R) (SEQ ID NO: 230), kivD(602F) (SEQ ID NO: 233), and kivD(1250F) (SEQ ID NO: 234). The correct isolates were designated as strain PNY1716 (=MATa ura3Δ::loxP his3Δ::loxP pdc6Δ pdc1Δ:: ilvD pdc5Δ::kivD(y)).

FRA2 Deletion and UAS(PGK1)-FBA1p-ilvD(y)-TEF1t Integration

The FRA2 coding region was deleted and replaced with a cassette UAS(PGK1)-FAB1p-ilvD(y)-TEF1t-HisG-URA3-HisG by homologous recombination. The cassette UAS (PGK1)-FAB1p-ilvD(y)-TEF1t-HisG-URA3-HisG contains the hybrid promoter UAS(PGK1)-FAB1p, ilvD(y) coding region from *Streptococcus mutans* ATCC® No. 700610™, codon optimized for expression in *Saccharomyces cerevisiae*, TEF1t terminator, and URA3 gene along with the promoter and terminator, flanked by HisG fragments.

A plasmid pRS423-TPI1p-ilvD(y) (SEQ ID NO: 235) was digested with restriction enzymes NotI and SalI, and the 2,270 bp TPI1p-ilvD(y) fragment was purified on an agarose gel followed by a gel extraction kit (Qiagen, Valencia, Calif.). TPI1p-ilvD(y) fragment was cloned into NotI and SalI sites on pMOD-URA3r2 (SEQ ID NO: 236) to construct pMOD-URA3r2-TPI1p-ilvD(y). pMOD-URA3r2 is pUC19 based and contains the sequence of the URA3 gene flanked by HisG fragments. PCR TEF1t (285 bp) was amplified from *Saccharomyces cerevisiae* genomic DNA as template using Phusion® High Fidelity PCR Master Mix (New England BioLabs Inc.; Ipswich, Mass.) with primer T-TEF1t(NotI) (SEQ ID NO: 237) and primer B-TEF1t (NotI) (SEQ ID NO: 238). PCR TEF1t fragment was digested with a restriction enzyme NotI and then cloned into a NotI site on pMOD-URA3r2-TPI1p-ilvD(y). The correct orientation of TEF1t was confirmed by colony PCR analysis with T-DSmo(RPS5p) (SEQ ID NO: 239) and B-TEF1t (NotI) (SEQ ID NO: 238) with 2,009 bp of expected size. The resulting plasmid was designated as pMOD-URA3r2-TPI1p-ilvD(y)-TEF1t. Then, the TPI1p promoter on pMOD-URA3r2-TPI1p-ilvD(y)-TEF1t was replaced with the hybrid promoter UAS(PGK1)-FBA1p (SEQ ID NO: 240). PCR UAS(PGK1)-FBA1p cassette was amplified from a plasmid pRS316-UAS(PGK1)-FBA1p-GUS (SEQ ID NO: 241) using Phusion® High Fidelity PCR Master Mix (New England BioLabs Inc.; Ipswich, Mass.) with primer T-U/ PGK1(XhoApa) (SEQ ID NO: 242) and primer B-FBA1 (SpeI) (SEQ ID NO: 243). PCR UAS(PGK1)-FBA1p product was digested with restriction enzymes XhoI and SpeI, and the PCR fragment was purified on an agarose gel followed by a gel extraction kit (Qiagen, Valencia, Calif.). pMOD-URA3r2-TPI1p-ilvD(y)-TEF1t was digested with restriction enzymes SalI and SpeI, and then 6,887 bp plasmid fragment lacking TPI1p was purified on an agarose gel followed by a gel extraction kit (Qiagen, Valencia, Calif.). The 6,887 bp pMOD-URA3r2-ilvD(y)-TEF1t was ligated with UAS(PGK1)-FBA1p product digested with XhoI and SpeI to create pMOD-URA3r2-UAS(PGK1)-FBA1p-ilvD (y)-TEF1t (SEQ ID NO: 244). PCR cassette UAS(PGK1)-FAB1p-ilvD(y)-TEF1t-HisG-URA3-HisG was amplified from a plasmid pMOD-URA3r2-UAS(PGK1)-FBA1p-ilvD (y)-TEF1t using Phusion® High Fidelity PCR Master Mix (New England BioLabs Inc.; Ipswich, Mass.) with primers T-FRA(Dsm) (SEQ ID NO: 245), containing the 5' region 50 bp upstream of the FRA2 ATG, and B-FRA(Dsm) (SEQ ID NO: 246), containing the 3' region 50 bp downstream of the FRA2 coding region. The PCR product was purified with a PCR purification kit (Qiagen, Valencia, Calif.).

Competent cells of PNY1716 were made and transformed with the PCR cassette UAS(PGK1)-FAB1p-ilvD(y)-TEF1t-HisG-URA3-HisG using a Frozen-EZ Yeast Transformation II™ kit (Zymo Research Corporation, Irvine, Calif.). Transformation mixtures were plated on synthetic complete media lacking uracil supplemented with 0.5% ethanol (no glucose) at 30° C. Transformants with a fra2 knockout UAS(PGK1)-FAB1p-ilvD(y)-TEF1t-HisG-URA3-HisG integration were screened for by PCR with primers oBP602 (SEQ ID NO: 247) and B-TEF1t(NotI) using genomic DNA prepared with a Gentra® Puregene® Yeast/Bact. kit (Qiagen, Valencia, Calif.). To remove the URA3 marker from the chromosome, correct transformants were grown overnight in YPE (0.5% ethanol) and plated on synthetic complete medium supplemented with ethanol (no glucose) and containing 5-fluoro-orotic acid (0.1%) at 30° C. to select for isolates that lost the URA3 marker. The deletion of FRA2, integration of UAS (PGK1)-FAB1p-ilvD(y)-TEF1t, and URA3 marker removal were confirmed by DNA sequencing with primers DSm(o) 50R (SEQ ID NO: 248), DSm(o)1F (SEQ ID NO: 249), DSm(o)688F (SEQ ID NO: 250), and DSm(o)1352F (SEQ ID NO: 251) using genomic DNA prepared with a Gentra® Puregene® Yeast/Bact. kit (Qiagen, Valencia, Calif.). The correct isolates were designated as strain PNY1720 (=MATa ura3Δ::loxP his3Δ::loxP pdc6Δ pdc1Δ::ilvD pdc5Δ::kivD(y) fra2Δ::UAS(PGK1)-FBA1p-ilvD(y)).

GPD2 Deletion and FBA1p-alsS Integration

The GPD2 coding region was deleted and replaced with the FAB1 promoter and alsS coding region coding region by homologous recombination with a PCR cassette (URA3-FBA1p-alsS) containing the URA3p-URA3-URA3t cassette flanked by the degenerated loxP71/loxP66 sites, FBA1 promoter from *Saccharomyces cerevisiae*, and alsS from *Bacillus subtilis* subsp. *subtilis* str. 168 (NC_000964).

PCR URA3p-URA3-URA3t fragment flanked by loxP71/ loxP66 sites was amplified from pLA59 (SEQ ID NO: 252) using Phusion® DNA polymerase (New England BioLabs Inc., Ipswich, Mass.) with primers T-URA(gpd_60 bp) (SEQ ID NO: 253), containing the 5' region 60 bp upstream of the GPD2 ATG, and B-URA(alsS) (SEQ ID NO: 254), containing a 3' tail with homology to the 5' end of the FBA1p-alsS fragment. PCR FBA1p-alsS fragment was amplified from pUC19-kan::pdc1::FBA-alsS::TRX1 (SEQ ID NO: 255) using Phusion® DNA polymerase (New England BioLabs Inc., Ipswich, Mass.) with primers T-alsS(URA) (SEQ ID NO: 256), containing a 5' tail with homology to the 3' end of the URA3p-URA3-URA3t fragment, and B-alsS(gpd_60 bp) (SEQ ID NO: 257), containing the 3' region 60 bp downstream of the GPD2 gene. The resulting PCR product was purified on an agarose gel followed by a gel extraction kit (Qiagen, Valencia, Calif.). The URA3-FBA1p-alsS cassette was created by overlapping PCR by mixing URA3p-URA3-URA3t fragment and FBA1p-alsS fragment and amplifying with primers T-URA(gpd_60 bp) and B-alsS (gpd_60 bp). The PCR product was purified with a PCR purification kit (Qiagen, Valencia, Calif.).

Competent cells of PNY1720 were made and transformed with the PCR cassette URA3-FBA1p-alsS using a Frozen-EZ Yeast Transformation II™ kit (Zymo Research Corporation, Irvine, Calif.). Transformation mixtures were plated on synthetic complete media lacking uracil supplemented with 0.5% ethanol (no glucose) at 30° C. Transformants with a gpd2 knockout URA3-FBA1p-alsS integration were screened for by PCR with primers FBA-als1557 (SEQ ID NO: 258) and gpd2-down178 (SEQ ID NO: 259) using genomic DNA prepared with a Gentra® Puregene® Yeast/Bact. kit (Qiagen, Valencia, Calif.). The URA3 marker was recycled by transformation with pRS423::$P_{GAL1}$-cre (SEQ ID NO: 260) and plating on synthetic complete media lacking histidine supplemented with 0.5% ethanol at 30° C. Transformants were streaked on synthetic complete medium supplemented with 0.5% ethanol and containing 5-fluoro-orotic acid (0.1%) and incubated at 30° C. to select for isolates that lost the URA3 marker. 5-FOA resistant isolates were grown in YPE (0.5% ethanol) for removal of the pRS423::$P_{GAL1}$-cre plasmid. The GPD2 deletion, FBA1p-alsS integration, and marker removal were checked by PCR with primers gpd2-up229 (SEQ ID NO: 261) and B-FBA1 (SpeI) (SEQ ID NO: 243), and confirmed by DNA sequencing with primers T-alsS(URA) (SEQ ID NO: 256), FBA-als752 (SEQ ID NO: 262), FBA-als1557 (SEQ ID NO: 258), and gpd2-down178 (SEQ ID NO: 259) using genomic DNA prepared with a Gentra® Puregene® Yeast/Bact. kit (Qiagen, Valencia, Calif.). The correct isolates were designated as strains PNY1725 (=MATa ura3Δ::loxP his3Δ::loxP pdc6Δ pdc1Δ::ilvD pdc5Δ::kivD(y) fra2Δ::UAS(PGK1)-FBA1p-ilvD(y) gpd2Δ::loxP71/66-FBA1p-alsS).

BDH1 Deletion and UAS(PGK1)-ENO2p-ilvD-TEF1t-ILV5p-adh Integration

The BDH1 coding region was deleted and replaced with a cassette UAS(PGK1)-ENO2p-ilvD-TEF1t-ILV5p-adh by homologous recombination. The BDH1 deletion and UAS (PGK1)-ENO2p-ilvD-TEF1t-ILV5p-adh integration cassette (A-UAS(PGK1)-ENO2p-ilvD-TEF1t-ILV5p-adh-B-U-C) contains the homology upstream (fragment A) and downstream (fragment B) of the BDH1 coding region, hybrid promoter UAS(PGK1)-ENO2p, ilvD coding region from Streptococcus mutans ATCC® No. 700610™, TEF1t terminator, ILV5p promoter, adh coding region along with the terminator from Beijerinckia indica, and a URA3 gene along with the promoter and terminator (fragment U) for selection of transformants, and the 3' region of the BDH1 coding region (fragment C). The fragment A, UAS(PGK1)-ENO2p, ilvD, TEF1t, ILV5p, adh, fragment B, fragment U and fragment C were cloned into pUC19 based plasmid to create pBP1339 (=pA-UAS(PGK1)-ENO2p-ilvD-TEF1t-ILV5p-adh-B-U-C) (SEQ ID NO: 263). PCR cassette A-UAS(PGK1)-ENO2p-ilvD-TEF1t-ILV5p-adh-B-U-C was amplified from pBP1339 using Phusion® DNA polymerase (New England BioLabs Inc., Ipswich, Mass.) with primers oBP685 (SEQ ID NO: 264) and oBP690 (SEQ ID NO: 265). The PCR product was purified with a PCR purification kit (Qiagen, Valencia, Calif.).

Competent cells of PNY1725 were made and transformed with the PCR cassette A-UAS(PGK1)-ENO2p-ilvD-TEF1t-ILV5p-adh-B-U-C using a Frozen-EZ Yeast Transformation II™ kit (Zymo Research Corporation, Irvine, Calif.). Transformation mixtures were plated on synthetic complete media lacking uracil supplemented with 0.5% ethanol (no glucose) at 30° C. Transformants with a bdh1 knockout UAS(PGK1)-ENO2p-ilvD-TEF1t-ILV5p-adh-B-U integration were screened for by PCR with primers oBP726 (SEQ ID NO: 266) and DSm1354F (SEQ ID NO: 267) using genomic DNA prepared with a Gentra® Puregene® Yeast/Bact. kit (Qiagen, Valencia, Calif.). To remove the URA3 marker from the chromosome, correct transformants were grown overnight in YPE (0.5% ethanol) and plated on synthetic complete medium supplemented with ethanol (no glucose) and containing 5-fluoro-orotic acid (0.1%) at 30° C. to select for isolates that lost the URA3 marker. The deletion of BDH1, integration of UAS(PGK1)-ENO2p-ilvD-TEF1t-ILV5p-adh, and URA3 marker removal were confirmed by DNA sequencing with primers DSm788R (SEQ ID NO: 268), DSm696F (SEQ ID NO: 269), DSm1354F (SEQ ID NO: 267), ADHBi643R (SEQ ID NO: 270), and ADHBi554F (SEQ ID NO: 271) using genomic DNA prepared with a Gentra® Puregene® Yeast/Bact. kit (Qiagen, Valencia, Calif.). The correct isolates were designated as strains PNY1730 (=MATa ura3Δ::loxP his3Δ::loxP pdc6Δ pdc1Δ::ilvD pdc5Δ::kivD (y) fra2Δ::UAS(PGK1)-FBA1p-ilvD(y)-gpd2Δ::loxP71/66-FBA1p-alsS bdh1Δ::UAS (PGK1)-ENO2p-ilvD-ILV5p-adh).

YMR226c Deletion

The gene YMR226c was deleted in strain PNY1730 by homologous recombination using a PCR amplified 2.0 kb linear scarless deletion cassette. The cassette was constructed from spliced PCR amplified fragments comprised of the URA3 gene, along with its native promoter and terminator as a selectable marker, upstream and downstream homology sequences flanking the YMR226c gene chromosomal locus to promote integration of the deletion cassette and removal of the native intervening sequence and a repeat sequence to promote recombination and removal of the URA3 marker. The 1,208 bp URA3 expression cassette was PCR-amplified from pLA33 (SEQ ID NO: 184) with forward and reverse PCR primers N1251 (SEQ ID NO: 272) and N1252 (SEQ ID NO: 273). Forward and reverse primers N1253 (SEQ ID NO: 274) and N1254 (SEQ ID NO: 275) amplified a 250 bp downstream homology sequence with a 3' URA3 overlap sequence tag from a genomic DNA preparation of S. cerevisiae strain PNY2211 (MATa ura3Δ::loxP his3Δ pdc6Δ pdc1Δ::P[PDC1]-DHAD|ilvD_Sm-PDC1t-P [FBA1]-ALS|alsS_Bs-CYC1t pdc5Δ::P[PDC5]-ADH|sad-B_Ax-PDC5t gpd2Δ::loxP fra2Δ adh1Δ::UAS(PGK1)P [FBA1]-kivD_L1(y)-ADH1t). Forward and reverse PCR primers N1256 (SEQ ID NO: 276) and N1255 (SEQ ID NO: 277) amplified a 250 bp repeat sequence with a 5' URA3 overlap sequence tag from a genomic DNA preparation of Saccharomyces cerevisiae strain PNY2211. Forward and reverse PCR primers N1257 (SEQ ID NO: 278) and N1258 (SEQ ID NO: 279) amplified a 250 bp upstream homology sequence with a 5' repeat overlap sequence tag from a genomic DNA preparation of Saccharomyces cerevisiae strain PNY2211.

Approximately 1.5 μg of the PCR amplified cassette was transformed into strain PNY1730 made competent using the Frozen-EZ Yeast Transformation II™ kit (Zymo Research Corporation, Irvine, Calif.) and the transformation mix plated on the synthetic complete media lacking uracil supplemented with 0.5% ethanol (no glucose) at 30° C. for selection of cells with an integrated ymr226cΔ::URA3 cassette. Transformants appearing after 72 to 96 hours are subsequently short-streaked on the same medium and incubated at 30° C. for 24 to 48 hours. The short-streaks are screened for ymr226cΔ::URA3 by PCR, with a 5' outward facing URA3 deletion cassette-specific internal primer N1249 (SEQ ID NO: 280) paired with a flanking inward facing chromosome-specific primer N1239 (SEQ ID NO: 281) and a 3' outward-facing URA3 deletion cassette-specific primer N1250 (SEQ ID NO: 282) paired with a flanking inward-facing chromosome-specific primer N1242 (SEQ ID NO: 283). A positive PNY1730 ymr226cΔ::URA3 PCR screen resulted in 5' and 3' PCR products of 598 and 726 bp, respectively.

The positive PNY1730 ymr226cΔ::URA3 clones were cultured overnight in a YPE (0.5% ethanol) and then was plated on synthetic complete medium supplemented with ethanol (no glucose) and containing 5-fluoro-orotic acid (0.1%) at 30° C. to select for isolates that lost the URA3 marker. Colonies appearing after 24 to 48 hours were PCR screened for marker loss with 5' and 3' chromosome-specific primers N1239 and N1242. A positive PNY1730 ymr226cΔ markerless PCR screen resulted in a PCR product of 801 bp. The strain PNY1730 ymr226cΔ was designated PNY1758 (=MATa ura3Δ::loxP his3Δ::loxP pdc6Δ pdc1Δ::ilvD pdc5Δ::kivD(y) fra2Δ::UAS(PGK1)-FBA1p-ilvD(y) gpd2Δ::loxP71/66-FBA1p-alsS-bdh1Δ::UAS(PGK1)-ENO2p-ilvD-ILV5p-adh ymr226cΔ).

PNY01758 was transformed with plasmid pK9D3.OLE1p.IlvD (SEQ ID NO: 284) carrying K9D3.KARI gene from Anaerostipes caccae DSM 14662 and carrying ilvD gene from Streptococcus mutans ATCC® No. 700610™. Competent cells of PNY01758 were made and transformed with plasmids pK9D3.OLE1p.IlvD (SEQ ID NO: 284) using a Frozen-EZ Yeast Transformation II™ kit (Zymo Research Corporation, Irvine, Calif.). Transformed cells were plated on synthetic complete media lacking uracil supplemented with 0.5% ethanol (no glucose) at 30° C. Resulting transformant was designated as the isobutanologen strain PNY01759 (=MATa ura3Δ::loxP his3Δ::loxP pdc6Δ pdc1Δ::ilvD pdc5Δ::kivD(y) fra2Δ::UAS (PGK1)-FBA1p-ilvD(y) gpd2Δ::loxP71/66-FBA1p-alsS bdh1Δ::UAS(PGK1)-ENO2p-ilvD-ILV5p-adh ymr226cΔ/ pK9D3.OLE1p.IlvD).

PNY01759 is a histidine auxotroph strain. The auxotrophy of the strain was changed to uracil because the wild-type YAP1 and YAP1 variants were cloned into p416 plasmid with uracil selection marker. To change auxotrophy of PNY01759, uracil selection marker was replaced with a PCR cassette with ORF of histidine gene flanked by upstream and downstream of uracil selection marker of pK9D3.OLE1p.IlvD (SEQ ID NO: 284). The PCR cassette was amplified from pK9D3.OLE1p.IlvD (SEQ ID NO: 284) using primers oBB210 (SEQ ID NO: 285) and oBB211 (SEQ ID NO: 286). The PCR product was transformed in PNY01759 using a Frozen-EZ Yeast Transformation II™ kit (Zymo Research Corporation, Irvine, Calif.) and transformants were selected on synthetic complete media lacking histidine supplemented with 0.5% ethanol (no glucose). Selected transformants were confirmed for uracil auxotrophy by growing the transformants on 5-FOA plates. A colony was purified, and the amplification of HIS3 ORF was confirmed as well as no amplification of URA3 ORF. The resulting transformant was designated as PNY03047 (=MATa ura3Δ::loxP his3Δ::loxP pdc6Δ pdc1Δ::ilvD pdc5Δ::kivD(y) fra2Δ::UAS(PGK1)-FBA1p-ilvD(y) gpd2Δ::loxP71/66-FBA1p-alsS bdh1Δ::UAS(PGK1)-ENO2p-ilvD-ILV5p-adh ymr226cΔ/ pK9D3.OLE1p.IlvD.HIS).

Example 6

Expression of Wild-Type YAP1 and YAP1 Variants in Isobutanol Strain

Plasmids (p416 TEF) carrying wild-type YAP1 or YAP1 variants were transformed in Saccharomyces cerevisiae strain PNY03047 using a Frozen-EZ Yeast Transformation II Kit™ (Zymo Research Corporation, Irvine, Calif.). Transformants were selected on synthetic complete media lacking histidine and uracil supplemented with 0.5% ethanol (no glucose). Transformants were purified on same plates and inoculated in liquid medium (synthetic complete media lacking histidine and uracil supplemented with 0.5% ethanol). Cells were grown in the same liquid media and concentrated to 20 $OD_{600}$ nm using cane production medium (CPM) (described below). The cells were incubated at 30° C. for 16 h with agitation (200 rpm). Isobutanol titer in the culture was estimated in HPLC assays. Results are shown in Table 12.

TABLE 12

| Isobutanol | Controls | | Variants of YAP1 Gene Overexpressed in Saccharomyces cerevisiae PNY03047 | | | | | | | | |
|---|---|---|---|---|---|---|---|---|---|---|---|
| Titer, g/L | p416 vector | WT YAP1 | B5-1 | C5-2 | B8-4 | C5-3 | E5-4 | B8-1 | D8-1 | D8-4 | F8-1 | B5-4 |
| Isobutanol titer (average) | 2.65 | 3.3 | 4.35 | 4.15 | 3.45 | 4.7 | 3.2 | 3.3 | 2.8 | 3.3 | 4.15 | 3.7 |

Cells overexpressing wild-type YAP1 and YAP1 variants produced more isobutanol compared to cells with p416 control. Isobutanol titer in cells overexpressing C5-2, C53, B5-1, and F8-1 is significantly higher compared to control.

Cane production medium (CPM) was prepared by dissolving the reagents listed in Table 13 in distilled water. Water was added to a volume of 1000 mL and the pH of the medium was adjusted to 5.5 by adding dilute acid/base. The vitamin solution used for preparation of CPM was made as 1000× stock (Table 14). The stock solution was prepared by dissolving reagents (except riboflavin) in 925 mL water. Riboflavin (0.75 gm) was dissolved in 75 mL 0.2 M sodium hydraxide solution and the pH was adjusted to 3.5 by using dilute sulfuric acid. This 75 mL solution was added to the vitamin mix to make 1000 mL vitamin solution 1000×.

TABLE 13

Cane production medium (CPM)

| Ingredients | UOM | 1 L Medium |
|---|---|---|
| $K_2HPO_4$ | gm | 6.0 |
| $CaCl_2 \cdot 2H_2O$ | gm | 0.076 |
| $MgSO_4 \cdot 7H_2O$ | gm | 1.0 |
| $MnCl_2 \cdot 4H_2O$ | gm | 0.10 |
| $ZnSO_4 \cdot 7H_2O$ | gm | 0.029 |
| $FeCl_3$ | gm | 0.006 |
| $Na_2SO_4$ | gm | 0.16 |
| YNB w/o amino acid | gm | 13.4 |
| Yeast Extract | gm | 6.0 |
| Sucrose | gm | 25.0 |
| Ethanol | mL | 6.25 |
| Vitamin solution | mL | 1.0 |
| MES* | gm | 19.5 |
| Ampicillin (5%) | mL | 1.0 |
| Chloramphenicol (34 mg/mL) | mL | 0.5 |
| Water (vol make up) | mL | 1000 |
| Adjust pH to 5.50 ± 0.1 | | |
| Filter sterilize and store at RT | | |

*MES: (2-(N-morpholino)ethanesulfonic acid

TABLE 14

Vitamin Solution 1000X

| Chemical/Product: | UOM | 1 L Medium |
|---|---|---|
| Biotin (D−) | gm | 0.05 |
| Ca D(+) panthotenate | gm | 1.0 |
| Nicotinic acid | gm | 15.0 |
| Myo-inositol (for microbiology) | gm | 25.0 |
| Thiamine chloride hydrochloride | gm | 20.0 |
| Pyridoxol hydrochloride | gm | 1.0 |
| p-Aminobenzoic acid | gm | 0.4 |
| Riboflavin | gm | 0.75 |
| Folic acid | gm | 0.004 |
| Water (vol make up) | mL | 1000 |

Example 7

Construction of Strain PNY2068

*Saccharomyces cerevisiae* strain PNY0827 was used as the host cell for further genetic manipulation. PNY0827 refers to a strain derived from *Saccharomyces cerevisiae* which has been deposited at the ATCC under the Budapest Treaty on Sep. 22, 2011 at the American Type Culture Collection, Patent Depository 10801 University Boulevard, Manassas, Va. 20110-2209 and has the patent deposit designation PTA-12105.

Deletion of URA3 and Sporulation into Haploids

In order to delete the endogenous URA3 coding region, a deletion cassette was PCR-amplified from pLA54 (SEQ ID NO: 179) which contains a $P_{TEF1}$-kanMX4-TEF1t cassette flanked by loxP sites to allow homologous recombination in vivo and subsequent removal of the KANMX4 marker. PCR was done by using Phusion® High Fidelity PCR Master Mix (New England BioLabs Inc.; Ipswich, Mass.) and primers BK505 (SEQ ID NO: 180) and BK506 (SEQ ID NO: 181). The URA3 portion of each primer was derived from the 5' region 180 bp upstream of the URA3 ATG and 3' region 78 bp downstream of the coding region such that integration of the kanMX4 cassette results in replacement of the URA3 coding region. The PCR product was transformed into PNY0827 using standard genetic techniques (Methods in Yeast Genetics, 2005, Cold Spring Harbor Laboratory Press, Cold Spring Harbor, N.Y., pp. 201-202) and transformants were selected on YEP medium supplemented 2% glucose and 100 µg/ml Geneticin at 30° C. Transformants were screened by colony PCR with primers LA468 (SEQ ID NO: 182) and LA492 (SEQ ID NO: 183) to verify presence of the integration cassette. A heterozygous diploid was obtained: NYLA98, which has the genotype MATa/α URA3/ura3::loxP-kanMX4-loxP. To obtain haploids, NYLA98 was sporulated using standard methods (Codón, et al., Appl. Environ. Microbiol. 61:630-638, 1995). Tetrads were dissected using a micromanipulator and grown on rich YPE medium supplemented with 2% glucose. Tetrads containing four viable spores were patched onto synthetic complete medium lacking uracil supplemented with 2% glucose, and the mating type was verified by multiplex colony PCR using primers AK109-1 (SEQ ID NO: 287), AK109-2 (SEQ ID NO: 288), and AK109-3 (SEQ ID NO: 289). The resulting identified haploid strain called NYLA103, which has the genotype: MATα ura3Δ::loxP-kanMX4-loxP, and NYLA106, which has the genotype: MATa ura3Δ::loxP-kanMX4-loxP.

Deletion of His3

To delete the endogenous HIS3 coding region, a scarless deletion cassette was used. The four fragments for the PCR cassette for the scarless HIS3 deletion were amplified using Phusion® High Fidelity PCR Master Mix (New England BioLabs Inc.; Ipswich, Mass.) and CEN.PK 113-7D (CBS 8340; Centraalbureau voor Schimmelcultures (CBS) Fungal Biodiversiry Centre, Netherlands) genomic DNA as template, prepared with a Gentra® Puregene® Yeast/Bact. Kit (Qiagen, Valencia, Calif.). HIS3 Fragment A was amplified with primer oBP452 (SEQ ID NO: 290) and primer oBP453 (SEQ ID NO: 291), containing a 5' tail with homology to the 5' end of HIS3 Fragment B. HIS3 Fragment B was amplified with primer oBP454 (SEQ ID NO: 292), containing a 5' tail with homology to the 3' end of HIS3 Fragment A, and primer oBP455 (SEQ ID NO: 293) containing a 5' tail with homology to the 5' end of HIS3 Fragment U. HIS3 Fragment U was amplified with primer oBP456 (SEQ ID NO: 294), containing a 5' tail with homology to the 3' end of HIS3 Fragment B, and primer oBP457 (SEQ ID NO: 295), containing a 5' tail with homology to the 5' end of HIS3 Fragment C. HIS3 Fragment C was amplified with primer oBP458 (SEQ ID NO: 296), containing a 5' tail with homology to the 3' end of HIS3 Fragment U, and primer oBP459 (SEQ ID NO: 297). PCR products were purified with a PCR Purification kit (Qiagen, Valencia, Calif.). HIS3 Fragment AB was created by overlapping PCR by mixing HIS3 Fragment A and HIS3 Fragment B and amplifying with primers oBP452 (SEQ ID NO: 290) and oBP455 (SEQ ID NO: 293). HIS3 Fragment UC was created by overlapping PCR by mixing HIS3 Fragment U and HIS3 Fragment C and amplifying with primers oBP456 (SEQ ID NO: 294) and oBP459 (SEQ ID NO: 297). The resulting PCR products were purified on an agarose gel followed by a Gel Extraction kit (Qiagen, Valencia, Calif.). The HIS3 ABUC cassette was created by overlapping PCR by mixing HIS3 Fragment AB and HIS3 Fragment UC and amplifying with primers oBP452 (SEQ ID NO: 290) and oBP459 (SEQ ID NO: 297). The PCR product was purified with a PCR Purification kit (Qiagen, Valencia, Calif.). Competent cells of NYLA106 were transformed with the HIS3 ABUC PCR cassette and were plated on synthetic complete medium lacking uracil supplemented with 2% glucose at 30° C. Transformants were screened to verify correct integration by replica plating onto synthetic complete medium lacking histidine and supplemented with 2% glucose at 30° C. Genomic DNA preps were made to verify the integration by PCR using primers oBP460 (SEQ ID NO: 298) and LA135 (SEQ ID NO: 299) for the 5' end and primers oBP461 (SEQ ID NO: 300) and LA92 (SEQ ID NO: 301) for the 3' end. The URA3 marker was recycled by plating on synthetic complete medium supplemented with 2% glucose and 5-FOA at 30° C. following standard protocols. Marker removal was confirmed by patching colonies from the 5-FOA plates onto SD-URA medium to verify the absence of growth. The resulting identified strain, called PNY2003 has the genotype: MATa ura3Δ::loxP-kanMX4-loxP his3Δ.

Deletion of PDC1

To delete the endogenous PDC1 coding region, a deletion cassette was PCR-amplified from pLA59 (SEQ ID NO: 252), which contains a URA3 marker flanked by degenerate loxP sites to allow homologous recombination in vivo and subsequent removal of the URA3 marker. PCR was done by using Phusion® High Fidelity PCR Master Mix (New England BioLabs Inc.; Ipswich, Mass.) and primers LA678 (SEQ ID NO: 302) and LA679 (SEQ ID NO: 303). The PDC1 portion of each primer was derived from the 5' region 50 bp downstream of the PDC1 start codon and 3' region 50 bp upstream of the stop codon such that integration of the URA3 cassette results in replacement of the PDC1 coding region but leaves the first 50 bp and the last 50 bp of the coding region. The PCR product was transformed into PNY2003 using standard genetic techniques and transformants were selected on synthetic complete medium lacking uracil and supplemented with 2% glucose at 30° C. Transformants were screened to verify correct integration by colony PCR using primers LA337 (SEQ ID NO: 304), external to the 5' coding region and LA135 (SEQ ID NO: 299), an internal primer to URA3. Positive transformants were then screened by colony PCR using primers LA692 (SEQ ID NO: 305) and LA693 (SEQ ID NO: 306), internal to the PDC1 coding region. The URA3 marker was recycled by transforming with pLA34 (SEQ ID NO: 307) containing the CRE recombinase under the GAL1 promoter and plated on synthetic complete medium lacking histidine and supplemented with 2% glucose at 30° C. Transformants were plated on rich medium supplemented with 0.5% galactose to induce the recombinase. Marker removal was confirmed by patching colonies to synthetic complete medium lacking uracil and supplemented with 2% glucose to verify absence of growth. The resulting identified strain, called PNY2008 has the genotype: MATa ura3Δ::loxP-kanMX4-loxP his3Δ pdc1Δ::loxP71/66.

Deletion of PDC5

To delete the endogenous PDC5 coding region, a deletion cassette was PCR-amplified from pLA59 (SEQ ID NO: 252), which contains a URA3 marker flanked by degenerate loxP sites to allow homologous recombination in vivo and subsequent removal of the URA3 marker. PCR was done by using Phusion® High Fidelity PCR Master Mix (New England BioLabs Inc.; Ipswich, Mass.) and primers LA722 (SEQ ID NO: 308) and LA733 (SEQ ID NO: 309). The PDC5 portion of each primer was derived from the 5' region 50 bp upstream of the PDC5 start codon and 3' region 50 bp downstream of the stop codon such that integration of the URA3 cassette results in replacement of the entire PDC5 coding region. The PCR product was transformed into PNY2008 using standard genetic techniques and transformants were selected on synthetic complete medium lacking uracil and supplemented with 1% ethanol at 30° C. Transformants were screened to verify correct integration by colony PCR using primers LA453 (SEQ ID NO: 310), external to the 5' coding region and LA135 (SEQ ID NO: 299), an internal primer to URA3. Positive transformants were then screened by colony PCR using primers LA694 (SEQ ID NO: 311) and LA695 (SEQ ID NO: 312), internal to the PDC5 coding region. The URA3 marker was recycled by transforming with pLA34 (SEQ ID NO: 307) containing the CRE recombinase under the GAL1 promoter and plated on synthetic complete medium lacking histidine and supplemented with 1% ethanol at 30° C. Transformants were plated on rich YEP medium supplemented with 1% ethanol and 0.5% galactose to induce the recombinase. Marker removal was confirmed by patching colonies to synthetic complete medium lacking uracil and supplemented with 1% ethanol to verify absence of growth. The resulting identified strain, called PNY2009 has the genotype: MATa ura3Δ::loxP-kanMX4-loxP his3Δ pdc1Δ::loxP71/66 pdc5Δ::loxP71/66.

Deletion of FRA2

The FRA2 deletion was designed to delete 250 nucleotides from the 3' end of the coding sequence, leaving the first 113 nucleotides of the FRA2 coding sequence intact. An in-frame stop codon was present 7 nucleotides downstream of the deletion. The four fragments for the PCR cassette for the scarless FRA2 deletion were amplified using Phusion® High Fidelity PCR Master Mix (New England BioLabs Inc.; Ipswich, Mass.) and CEN.PK 113-7D (CBS 8340; Centraalbureau voor Schimmelcultures (CBS) Fungal Biodiversiry Centre, Netherlands) genomic DNA as template, prepared with a Gentra® Puregene® Yeast/Bact. kit (Qiagen, Valencia, Calif.). FRA2 Fragment A was amplified with primer oBP594 (SEQ ID NO: 313) and primer oBP595 (SEQ ID NO: 314), containing a 5' tail with homology to the 5' end of FRA2 Fragment B. FRA2 Fragment B was amplified with primer oBP596 (SEQ ID NO: 315), containing a 5" tail with homology to the 3' end of FRA2 Fragment A, and primer oBP597 (SEQ ID NO: 316), containing a 5' tail with homology to the 5' end of FRA2 Fragment U. FRA2 Fragment U was amplified with primer oBP598 (SEQ ID NO: 317), containing a 5' tail with homology to the 3' end of FRA2 Fragment B, and primer oBP599 (SEQ ID NO: 318), containing a 5' tail with homology to the 5' end of FRA2 Fragment C. FRA2 Fragment C was amplified with primer oBP600 (SEQ ID NO: 319), containing a 5' tail with homology to the 3' end of FRA2 Fragment U, and primer oBP601 (SEQ ID NO: 320). PCR products were purified with a PCR Purification kit (Qiagen, Valencia, Calif.). FRA2 Fragment AB was created by overlapping PCR by mixing FRA2 Fragment A and FRA2 Fragment B and amplifying with primers oBP594 (SEQ ID NO: 313) and oBP597 (SEQ ID NO: 316). FRA2 Fragment UC was created by overlapping PCR by mixing FRA2 Fragment U and FRA2 Fragment C and amplifying with primers oBP598 (SEQ ID NO: 317) and oBP601 (SEQ ID NO: 320). The resulting PCR products were purified on an agarose gel followed by a Gel Extraction kit (Qiagen, Valencia, Calif.). The FRA2 ABUC cassette was created by overlapping PCR by mixing FRA2 Fragment AB and FRA2 Fragment UC and amplifying with primers oBP594 (SEQ ID NO: 313) and oBP601 (SEQ ID NO: 320). The PCR product was purified with a PCR Purification kit (Qiagen, Valencia, Calif.).

To delete the endogenous FRA2 coding region, the scarless deletion cassette obtained above was transformed into PNY2009 using standard techniques and plated on synthetic complete medium lacking uracil and supplemented with 1% ethanol. Genomic DNA preps were made to verify the integration by PCR using primers oBP602 (SEQ ID NO:

247) and LA135 (SEQ ID NO: 299) for the 5' end, and primers oBP602 (SEQ ID NO: 247) and oBP603 (SEQ ID NO: 321) to amplify the whole locus. The URA3 marker was recycled by plating on synthetic complete medium supplemented with 1% ethanol and 5-FOA (5-Fluoroorotic Acid) at 30° C. following standard protocols. Marker removal was confirmed by patching colonies from the 5-FOA plates onto synthetic complete medium lacking uracil and supplemented with 1% ethanol to verify the absence of growth. The resulting identified strain, PNY2037, has the genotype: MATa ura3Δ::loxP-kanMX4-loxP his3Δ pdc1Δ::loxP71/66 pdc5Δ::loxP71/66 fra2Δ.

Addition of Native 2 Micron Plasmid

The loxP71-URA3-loxP66 marker was PCR-amplified using Phusion DNA polymerase (New England BioLabs; Ipswich, Mass.) from pLA59 (SEQ ID NO: 252), and transformed along with the LA811 (SEQ ID NO: 322) and LA817 (SEQ ID NO: 323) and LA812 (SEQ ID NO: 324) and LA818 (SEQ ID NO: 325) 2-micron plasmid fragments into strain PNY2037 on SE-URA plates at 30° C. The resulting strain PNY2037 2μ::loxP71-URA3-loxP66 was transformed with pLA34 (pRS423::cre) (also called, pLA34) (SEQ ID NO: 307) and selected on SE-HIS-URA plates at 30° C. Transformants were patched onto YP-1% galactose plates and allowed to grow for 48 hr at 30° C. to induce Cre recombinase expression. Individual colonies were then patched onto SE-URA, SE-HIS, and YPE plates to confirm URA3 marker removal. The resulting identified strain, PNY2050, has the genotype: MATa ura3Δ::loxP-kanMX4-loxP, his3Δ pdc1Δ::loxP71/66 pdc5Δ::loxP71/66 fra2Δ 2-micron.

Deletion of GPD2

To delete the endogenous GPD2 coding region, a deletion cassette was PCR-amplified from pLA59 (SEQ ID NO: 252), which contains a URA3 marker flanked by degenerate loxP sites to allow homologous recombination in vivo and subsequent removal of the URA3 marker. PCR was done by using Phusion® High Fidelity PCR Master Mix (New England BioLabs Inc.; Ipswich, Mass.) and primers LA512 (SEQ ID NO: 326) and LA513 (SEQ ID NO: 327). The GPD2 portion of each primer was derived from the 5' region 50 bp upstream of the GPD2 start codon and 3' region 50 bp downstream of the stop codon such that integration of the URA3 cassette results in replacement of the entire GPD2 coding region. The PCR product was transformed into PNY2050 using standard genetic techniques and transformants were selected on synthetic complete medium lacking uracil and supplemented with 1% ethanol at 30° C. Transformants were screened to verify correct integration by colony PCR using primers LA516 (SEQ ID NO: 328), external to the 5' coding region and LA135 (SEQ ID NO: 299), internal to URA3. Positive transformants were then screened by colony PCR using primers LA514 (SEQ ID NO: 329) and LA515 (SEQ ID NO: 330), internal to the GPD2 coding region. The URA3 marker was recycled by transforming with pLA34 (SEQ ID NO: 307) containing the CRE recombinase under the GAL1 promoter and plated on synthetic complete medium lacking histidine and supplemented with 1% ethanol at 30° C. Transformants were plated on rich medium supplemented with 1% ethanol and 0.5% galactose to induce the recombinase. Marker removal was confirmed by patching colonies to synthetic complete medium lacking uracil and supplemented with 1% ethanol to verify absence of growth. The resulting identified strain, PNY2056, has the genotype: MATa ura3Δ::loxP-kanMX4-loxP his3Δ pdc1Δ::loxP71/66 pdc54::loxP71/66 fra2Δ 2-micron gpd2Δ.

Deletion of YMR226 and integration of AlsS

To delete the endogenous YMR226C coding region, an integration cassette was PCR-amplified from pLA71 (SEQ ID NO: 331), which contains the gene acetolactate synthase from the species *Bacillus subtilis* with a FBA1 promoter and a CYC1 terminator, and a URA3 marker flanked by degenerate loxP sites to allow homologous recombination in vivo and subsequent removal of the URA3 marker. PCR was done by using KAPA HiFi™ (Kapa Biosystems, Woburn, Mass.) and primers LA829 (SEQ ID NO: 332) and LA834 (SEQ ID NO: 333). The YMR226C portion of each primer was derived from the first 60 bp of the coding sequence and 65 bp that are 409 bp upstream of the stop codon. The PCR product was transformed into PNY2056 using standard genetic techniques and transformants were selected on synthetic complete medium lacking uracil and supplemented with 1% ethanol at 30° C. Transformants were screened to verify correct integration by colony PCR using primers N1257 (SEQ ID NO: 278), external to the 5' coding region and LA740 (SEQ ID NO: 334), internal to the FBA1 promoter. Positive transformants were then screened by colony PCR using primers N1257 (SEQ ID NO: 278) and LA830 (SEQ ID NO: 335), internal to the YMR226C coding region, and primers LA830 (SEQ ID NO: 335), external to the 3' coding region, and LA92 (SEQ ID NO: 336), internal to the URA3 marker. The URA3 marker was recycled by transforming with pLA34 (SEQ ID NO: 307) containing the CRE recombinase under the GAL1 promoter and plated on synthetic complete medium lacking histidine and supplemented with 1% ethanol at 30° C. Transformants were plated on rich medium supplemented with 1% ethanol and 0.5% galactose to induce the recombinase. Marker removal was confirmed by patching colonies to synthetic complete medium lacking uracil and supplemented with 1% ethanol to verify absence of growth. The resulting identified strain, PNY2061, has the genotype: MATa ura3Δ::loxP-kanMX4-loxP his3Δ pdc1Δ::loxP71/66 pdc5 Δ::loxP71/66 fra2Δ 2-micron gpd2Δ ymr226cΔ::P$_{FBA1}$-alsS_Bs-CYC1t-loxP71/66.

Deletion of ALD6 and integration of KivD

To delete the endogenous ALD6 coding region, an integration cassette was PCR-amplified from pLA78 (SEQ ID NO: 337), which contains the kivD gene from the species *Listeria grayi* with a hybrid FBA1 promoter and a TDH3 terminator, and a URA3 marker flanked by degenerate loxP sites to allow homologous recombination in vivo and subsequent removal of the URA3 marker. PCR was done by using KAPA HiFi™ (Kapa Biosystems, Woburn, Mass.) and primers LA850 (SEQ ID NO: 338) and LA851 (SEQ ID NO: 339). The ALD6 portion of each primer was derived from the first 65 bp of the coding sequence and the last 63 bp of the coding region. The PCR product was transformed into PNY2061 using standard genetic techniques and transformants were selected on synthetic complete medium lacking uracil and supplemented with 1% ethanol at 30° C. Transformants were screened to verify correct integration by colony PCR using primers N1262 (SEQ ID NO: 340), external to the 5' coding region and LA740 (SEQ ID NO: 334), internal to the FBA1 promoter. Positive transformants were then screened by colony PCR using primers N1263 (SEQ ID NO: 341), external to the 3' coding region, and LA92 (SEQ ID NO: 336), internal to the URA3 marker. The URA3 marker was recycled by transforming with pLA34 (SEQ ID NO: 307) containing the CRE recombinase under the GAL1 promoter and plated on synthetic complete medium lacking histidine and supplemented with 1% ethanol at 30° C. Transformants were plated on rich medium supplemented with 1% ethanol and 0.5% galactose to induce the recombinase. Marker removal was confirmed by patching colonies to synthetic complete medium lacking uracil and supplemented with 1% ethanol to verify absence of growth. The resulting identified strain, PNY2065, has the genotype: MATa ura3Δ::loxP-kanMX4-loxP his3Δ pdc1Δ::loxP71/66 pdc5Δ::loxP71/66 fra2Δ 2-micron gpd2Δ ymr226cΔ::P$_{FBA1}$-alsS_Bs-CYC1t-loxP71/66 ald6Δ::(UAS)PGK1-P$_{FBA1}$-kivD_Lg-TDH3t-loxP71.

Deletion of ADH1 and integration of ADH

ADH1 is the endogenous alcohol dehydrogenase present in *Saccharomyces cerevisiae*. As described below, the endogenous ADH1 was replaced with alcohol dehydrogenase (ADH) from *Beijerinckii indica*.

To delete the endogenous ADH1 coding region, an integration cassette was PCR-amplified from pLA65 (SEQ ID NO: 342), which contains the alcohol dehydrogenase from the species *Beijerinckii indica* with an ILV5 promoter and a ADH1 terminator, and a URA3 marker flanked by degenerate loxP sites to allow homologous recombination in vivo and subsequent removal of the URA3 marker. PCR was done by using KAPA HiFi™ (Kapa Biosystems, Woburn, Mass.) and primers LA855 (SEQ ID NO: 343) and LA856 (SEQ ID NO: 344). The ADH1 portion of each primer was derived from the 5' region 50 bp upstream of the ADH1 start codon and the last 50 bp of the coding region. The PCR product was transformed into PNY2065 using standard genetic techniques and transformants were selected on synthetic complete medium lacking uracil and supplemented with 1% ethanol at 30° C. Transformants were screened to verify correct integration by colony PCR using primers LA414 (SEQ ID NO: 345), external to the 5' coding region and LA749 (SEQ ID NO: 346), internal to the ILV5 promoter. Positive transformants were then screened by colony PCR using primers LA413 (SEQ ID NO: 347), external to the 3' coding region, and LA92 (SEQ ID NO: 336), internal to the URA3 marker. The URA3 marker was recycled by transforming with pLA34 (SEQ ID NO: 307) containing the CRE recombinase under the GAL1 promoter and plated on synthetic complete medium lacking histidine and supplemented with 1% ethanol at 30° C. Transformants were plated on rich medium supplemented with 1% ethanol and 0.5% galactose to induce the recombinase. Marker removal was confirmed by patching colonies to synthetic complete medium lacking uracil and supplemented with 1% ethanol to verify absence of growth. The resulting identified strain, called PNY2066 has the genotype: MATa ura3Δ::loxP-kanMX4-loxP his3Δ pdc1Δ::loxP71/66 pdc5Δ::loxP71/66 fra2Δ 2-micron gpd2Δ ymr226cΔ::P$_{FBA1}$-alsS_Bs-CYC1t-loxP71/66 ald6Δ::(UAS)PGK1-P$_{FBA1}$-kivD_Lg-TDH3t-loxP71/66 adh1Δ::P$_{ILV5}$-ADH_Bi(y)-ADH1t-loxP71/66.

Integration of ADH into pdc1Δ Locus

To integrate an additional copy of ADH at the pdc1Δ region, an integration cassette was PCR-amplified from pLA65 (SEQ ID NO: 342), which contains the alcohol dehydrogenase from the species *Beijerinckii indica* with an ADH1 terminator, and a URA3 marker flanked by degenerate loxP sites to allow homologous recombination in vivo and subsequent removal of the URA3 marker. PCR was done by using KAPA HiFi™ (Kapa Biosystems, Woburn, Mass.) and primers LA860 (SEQ ID NO: 348) and LA679 (SEQ ID NO: 303). The PDC1 portion of each primer was derived from the 5' region 60 bp upstream of the PDC1 start codon and 50 bp that are 103 bp upstream of the stop codon. The endogenous PDC1 promoter was used. The PCR product was transformed into PNY2066 using standard genetic techniques and transformants were selected on synthetic complete medium lacking uracil and supplemented with 1% ethanol at 30° C. Transformants were screened to verify correct integration by colony PCR using primers LA337 (SEQ ID NO: 304), external to the 5' coding region and N1093 (SEQ ID NO: 349), internal to the BiADH gene. Positive transformants were then screened by colony PCR using primers LA681 (SEQ ID NO: 350), external to the 3' coding region, and LA92 (SEQ ID NO: 336), internal to the URA3 marker. The URA3 marker was recycled by transforming with pLA34 (SEQ ID NO: 307) containing the CRE recombinase under the GAL1 promoter and plated on synthetic complete medium lacking histidine and supplemented with 1% ethanol at 30° C. Transformants were plated on rich medium supplemented with 1% ethanol and 0.5% galactose to induce the recombinase. Marker removal was confirmed by patching colonies to synthetic complete medium lacking uracil and supplemented with 1% ethanol to verify absence of growth. The resulting identified strain, called PNY2068 has the genotype: MATa ura3Δ::loxP-kanMX4-loxP his3Δ pdc1Δ::loxP71/66 pdc5Δ::loxP71/66 fra2Δ 2-micron gpd2Δ ymr226cΔ::P$_{FBA1}$-alsS_Bs-CYC1t-loxP71/66 ald6Δ::(UAS)PGK1-P$_{FBA1}$-kivD_Lg-TDH3t-loxP71/66 adh1Δ::P$_{ILV5}$-ADH_Bi(y)-ADH1t-loxP71/66 pdc1Δ::P$_{PDC1}$-ADH_Bi(y)-ADH1t-loxP71/66.

The strain PNY2068 was transformed with the plasmid pLH689 which includes genes encoding enzymes of the isobutanol pathway. The plasmid pLH689 [pHR81-Ilv5p-K9JB4P.KARI-TEF(M7)p-IlvD.Strep] (SEQ ID NO: 351) was constructed to contain a chimeric gene having the coding region of a variant of the ilvC gene from *Anaerostipes caccae* (protein—SEQ ID NO: 352; nucleotide—SEQ ID NO: 353) (nt 1628-2659) expressed from the yeast ILV5 promoter (nt 427-1620) and followed by the ILV5 terminator (nt 2685-3307) for expression of KARI, and the coding sequence of the ilvD gene from *Streptococcus mutans* (nt position 5377-3641) expressed from the yeast TEF(M7) mutant promoter (nt 5787-5387) (Alper, et al., Proc. Natl. Acad. Sci. 102:12678-12683, 2005) and followed by the FBA1 terminator (nt 3632-3320) for expression of DHAD.

Example 8

Expression of Genes Associated with the Oxidative Stress Pathway

Genes associated with the oxidative stress pathway were expressed in an isobutanologen to analyze the impact of overexpression of these genes on growth and isobutanol production.

A control plasmid, pBP2642 (SEQ ID NO: 354), was generated from the plasmid pRS413 (ATCC® No. 97518™). The plasmid pBP2642 (pRS413-GPM1p-ADHt) contains GPM1 promoter followed by ADH1 terminator.

TRX2 (SEQ ID NO: 355), YBP1 (SEQ ID NO: 28), and YAP1 (SEQ ID NO: 3) were PCR amplified using yeast strain *Saccharomyces cerevisiae* PNY827 (ATCC® Patent Deposit Designation: PTA-12105) genomic DNA as template. TRX2 was amplified using PCR primers OT1666 (SEQ ID NO: 356) and OT1667 (SEQ ID NO: 357) and cloned into the plasmid pBP2642, generating pRS413-GPM1-TRX2 (SEQ ID NO: 358). Plasmid pRS413-GPM1-TRX2 is a single copy plasmid which consists of a chimeric gene having the coding sequence of TRX2 gene expressed from the yeast GPM1 promoter, and followed by the ADH1 terminator.

YBP1 was amplified using PCR primers OT1656 (SEQ ID NO: 359) and OT1657 (SEQ ID NO: 360) and cloned into the plasmid pBP2642, generating pRS413-GPM1-YBP1 (SEQ ID NO: 361). Plasmid pRS413-GPM1-YBP1 is a single copy plasmid which consists of a chimeric gene having the coding sequence of YBP1 gene expressed from the yeast GPM1 promoter, and followed by the ADH1 terminator.

YAP1 was amplified using PCR primers OT1595 (SEQ ID NO: 362) and OT1596 (SEQ ID NO: 363) and cloned into the plasmid pBP2642, generating pRS413-GPM1-YAP1 (SEQ ID NO: 364). Plasmid pRS413-GPM1-YAP1 is a single copy plasmid which consists of a chimeric gene having the coding sequence of YAP1 gene expressed from the yeast GPM1 promoter, and followed by the CYC1 terminator.

The yeast strain PNY2068 was transformed with the plasmid pLH689, and either the control plasmid pBP2642 or a plasmid expressing TRX2 (pRS413-GPM1-Trx2), YBP1 (pRS413-GPM1-Ybp1), or YAP1 (pRS413-GPM1-YAP1) (Table 15).

TABLE 15

| Strain | Host | Plasmid | Plasmid |
|---|---|---|---|
| YS348 | PNY2068 | pBP2642 | pRS413-GPM1 |
| YS349 | PNY2068 | pLH692 | pRS413-GPM1-TRX2 |
| YS355 | PNY2068 | pLH698 | pRS413-GPM1-YBP1 |
| YS369 | PNY2068 | pLH769 | pRS413-GPM1-YAP1 |

The transformed cells were plated onto SE-Ura-His agar plates. SE-Ura-His media is synthetic minimal dropout media. The standard Synthetic Minimal Dropout Media that contains 2% ethanol (SE media) as carbon source is described in Table 16 and standard Synthetic Minimal Dropout Media that contains 2-3% glucose (SD media) as carbon source is described in Table 17.

TABLE 16

Synthetic Minimal Dropout Media (2% ethanol)

| Ingredients | UOM | 1 L Medium |
|---|---|---|
| Yeast Nitrogen Base without Amino Acids | gm | 6.7 |
| Amino Acid Dropout Supplement (-Ura, -His) | gm | 0.75 |
| 100% Ethanol | mL | 20 |
| Water (vol make up) | mL | 1000 |
| Filter sterilize | | |

TABLE 17

Synthetic Minimal Dropout Media (2-3% glucose)

| Ingredients | UOM | 1 L Medium |
|---|---|---|
| Yeast Nitrogen Base without Amino Acids | gm | 6.7 |
| Amino Acid Dropout Supplement (-Ura, -His) | gm | 0.75 |
| 50% Glucose | | |
| NaOAc (3M) (Final: 2 mM) | mL | 0.67 |
| MES, pH 5.5 (1M) (Final: 50 mM) | mL | 50 |
| Thiamine (5 g/L) (Final: 30 mg/L) | mL | 6 |
| Nicotinic acid (5 g/L) (Final: 30 mg/L) | mL | 6 |
| Water (vol make up) | mL | 1000 |
| Filter sterilize | | |

Example 9

Glucose Consumption and Isobutanol Production

Transformed yeast cells were grown on the SE-Ura-His plates for about five days. Colonies were re-streaked onto SE-Ura-His agar plates as cell patches and incubated at 30° C. for two days. The cell patches were used to inoculate 10 mL SE-Ura-His media containing 0.3% glucose and 2 mM NaOAc, and grown overnight aerobically in 125 mL plastic shake flasks at 30° C. and 250 rpm, to ~2 OD. The shake flasks have a lid with a sterile filter which facilitates aeration (VWR International, LLC, Arlington Heights, Ill.). After the overnight incubation, the cells were centrifuged for 5 min at 3000 rpm at room temperature, and re-suspended in 1 mL SD-Ura-His media with 3% glucose and 2 mM sodium acetate. An appropriate volume of cells were used to inoculate 30 mL of the same media in a 125 mL shake flask so that the $OD_{600}$ of the culture was at 0.2. The cultures were then incubated aerobically at 30° C. for 5-6 h at 250 rpm, until the $OD_{600}$ was about 0.4-0.5. The cells were centrifuged again for 5 min at 3000 rpm at room temperature. After re-suspending the cell pellets in 30 mL of SD-Ura-His media with 3% glucose and 2 mM sodium acetate, the cells were transferred to 60 mL serum vials and closed with crimped top rubber lid (to limit oxygen transfer). Three replicate cultures were grown for each strain in serum vials and the cultures were incubated at 30° C. for 41 h at 200 rpm. The $OD_{600}$ of the cultures was measured at time 0 h and at 41 h. The results are shown in Table 18.

TABLE 18

| Strains | $OD_{600}$ (time = 0 h) | $OD_{600}$ (time = 41 h) |
|---|---|---|
| YS348 | 0.3 | 1.69 |
| YS349 | 0.3 | 2.37 |
| YS355 | 0.3 | 1.89 |
| YS369 | 0.3 | 1.53 |

As shown in Table 18, the control strain YS348 had an $OD_{600}$ of 1.69 OD and the TRX2-expressing strain YS349 had an $OD_{600}$ of 2.37, suggesting a growth improvement of the YS349 strain due to the overexpression of TRX2 under the yeast GPM1 promoter.

Glucose consumption and isobutanol titer were also measured. The results are shown in Table 19. Data is average of three replicates and units are mM. With an initial glucose concentration at 176 mM, all cultures had glucose remaining in the serum vials after 41 h incubation. For isobutanol titer, YS349 had a higher isobutanol titer compared to YS348 (control). Therefore, overexpression of the TRX2 gene under the GPM1 promoter led to both improved growth and higher titer of the isobutanol producing strain.

TABLE 19

| Strains | Glucose Consumption (mM) | Isobutanol Titer (mM) |
|---|---|---|
| YS348 | 144.6 | 88.2 |
| YS349 | 157.5 | 101.7 |
| YS355 | 142.8 | 91.9 |
| YS369 | 130.0 | 88.3 |

In terms of isobutanol yields, YS349, YS355, and YS369 generated at least >10% yield improvement (Table 20). The data is the average of three replicates and the yields were calculated as titer of isobutanol (g/L) divided by glucose consumption (g/L). The data suggests that expression of TRX2, YBP1, and YAP1 under an appropriate promoter (e.g., GPM1) can improve the oxidative stress tolerance of the host strain, which can result in an improvement in strain performance.

TABLE 20

| Strains | Isobutanol Yield (g/g) |
|---|---|
| YS348 | 0.25 |
| YS349 | 0.27 |
| YS355 | 0.27 |
| YS369 | 0.28 |

It is possible that the combined expression of one or more of the genes associated with the oxidative stress pathway including TRX1, TRX2, YBP1, YAP1, GSH1, GPX1, and TRR1 can further improve the oxidative stress tolerance of alcohol-producing strains such as isobutanol-producing strains.

Example 10

Expression of Repeat Motifs

YAP1.MT1 mutant was designed to contain the insertion of the nucleotide sequence SEQ ID NO: 365 between nucleotide 1231 and 1232 in the wild type YAP1 gene. Two PCR reactions were performed using the Saccharomyces cerevisiae PNY827 (ATCC® Patent Deposit Designation: PTA-12105) genomic DNA as template to obtain Fragment 1, with 5' primer OT1595 (SEQ ID NO: 362) and 3' PCR primer OT1713 (SEQ ID NO: 366); and Fragment 2, with 5' primer OT1695 (SEQ ID NO: 367) and OT1596 (SEQ ID NO: 363). The PCR reaction was performed using Phusion® DNA polymerase (New England BioLabs Inc., Ipswich, Mass.) using standard conditions. Fragment 1 and 2 were purified and annealed by PCR reaction at 10 cycles of 98° C., 1 s, 63° C., 5 s, 72° C., 45 s, and 72° C. for 45 s. The annealed product was further amplified using OT1595 (SEQ ID NO: 362) and OT1596 (SEQ ID NO: 363) to give the fusion PCR product of YAP1.MT, which was subcloned into pCR®-Blunt-TOPO® vector (Invitrogen, Life Technologies, Grand Island, N.Y.) and verified by sequencing. YAP1.MT1 protein contains the insertion of amino acid sequence, STGSTD.

All documents cited herein, including journal articles or abstracts, published or corresponding U.S. or foreign patent applications, issued or foreign patents, or any other documents, are each entirely incorporated by reference herein, including all data, tables, figures, and text presented in the cited documents.

Those skilled in the art will recognize, or be able to ascertain using no more than routine experimentation, many equivalents to the specific embodiments of the invention described herein. Such equivalents are intended to be encompassed by the following claims.

SEQUENCE LISTING (368 sequences)

SEQ ID NO: 1 - DNA, 18 bp, Artificial Sequence
  Nucleotide sequence for tripeptide repeat region
atagcactggtagcactg

SEQ ID NO: 2 - DNA, 1953 bp, Saccharomyces cerevisiae
atgagtgtgtctaccgccaagaggtcgctggatgtcgtttctccgggttcattagcggagtttgagggttcaaaatctcgtcacgatgaaatagaaaatgaacatagacgtactggtacacgtgatggcgaggatagcgagcaaccgaagaagaagggtagcaaaactagcaaaaagcaagatttggatcctgaaactaagcagaagaggactgcccaaaatcgggccgctcaaagagcttttagggaacgtaaggagaggaagatgaaggaattggagaagaaggtacaaagtttagagagtattcagcagcaaaatgaagtggaagctacttttttgagggaccagttaatcactctggtgaatgagttaaaaaaatatagaccagagacaagaaatgactcaaaagtgctggaatatttagcaaggcgagatcctaatttgcatttttcaaaaaataacgttaaccacagcaatagcgagccaattgacacacccaatgatgacatacaagaaaatgttaaacaaaagatgaatttcacgtttcaatatccgcttgataacgacaacgacaacgacaacagtaaaaatgtggggaaacaattaccttcaccaaatgatccaagtcattcggctcctatgcctataaatcagacacaaaagaaattaagtgacgctacagattcctccagcgctactttggattccctttcaaatagtaacgatgttcttaataacacaccaaactcctccacttcgatggattggttagataatgtaatatatactaacaggtttgtgtcaggtgatgatggcagcaatagtaaaactaagaatttagacagtaatatgttttctaatgactttaattttgaaaaccaatttgatgaacaagtttcggagttttgttcgaaaatgaaccaggtatgtggaacaaggcaatgtcccattcccaagaaacccatctcggctcttgataaagaagttttcgcgtcatcttctatactaagttcaaattctcctgctttaacaaatacttgggaatcacattctaatattacagataatactcctgctaatgtcattgctactgatgctactaaatatgaaaattccttctccggttttggccgacttggtttcgatatgagtgccaatcattacgtcgtgaatgataatagcactggtagcactgatagcactggtagcactggcaataagaacaaaaagaacaataataatagcgatgatgtactcccattcatatccgagtcaccgtttgatatgaaccaagttactaatttttttagtccgggatctaccggcatcggcaataatgctgcctctaacaccaatcccagcctactgcaaagcagcaaagaggatataccttttatcaacgcaaatctggctttcccagacgacaattcaactaatattcaattacaacctttctctgaatctcaatctcaaaataagtttgactacgacatgttttttagagattcatcgaaggaaggtaacaatttatttggagagtttttagaggatgacgatgatgacaaaaaagccgctaatatgtcagacgatgagtcaagtttaatcaagaaccagttaattaacgaagaaccagagcttccgaaacaatatctacaatcggtaccaggaaatgaaagcgaaatctcacaaaaaaatggcagtagtttacagaatgctgacaaaatcaataatggcaatgataacgataatgataatgatgtcgttccatctaaggaaggctctttactaaggtgttcggaaatttgggatagaataacaacacatccgaaatactcagatattgatgtcgatggtttatgttccgagctaatggcaaaggcaaaatgttcagaaagaggggttgtcatcaatgcagaagacgttcaattagctttgaataagcatatgaactaa

SEQ ID NO: 3 - DNA, 1971 bp, Saccharomyces cerevisiae
atgagtgtgtctaccgccaagaggtcgctggatgtcgtttctccgggttcattagcggagtttgagggttcaaaatctcgtcacgatgaaatagaaaatgaacatagacgtactagtacacgtgatggcgaggatagcgagcaaccgaagaagaagggtagcaaaactagcaaaaagcaagatttggatcctgaaactaagcagaagaggactgcccaaaatcgggccgctcaaagagcttttagggaacgtaaggagaggaagatgaaggaattggagaagaaggtacaaagtttagagagtattcagcagcaaaatgaagtggaagctacttttttgagggaccagttaatcactctggtgaatgagttaaaaaaatatagaccagagacaagaaatgactcaaaagtgctggaatatttagcaaggcgagatcctaatttgcatttttcaaaaaataacgttaaccacagcaatagcgagccaattgacacacccaatgatgacatacaagaaaatgttaaacaaaagatgaatttcacgtttcaatatccgcttgataacgacaacgacaacgactacagtaaaaatgtggggaaacaattaccttcaccaaatgatccaagtcattcggctcctatgcctataaatcagacacaaaagaaattaagtgacgctacagattcctccagcgctactttggattccctttcaaatagtaacgatgttcttaataacacaccaaactcctccacttcgatggattggttagataatgtaatatatactaacaggtttgtgtcaggtgatgatggcagcaatagtaaaactaagaatttagacagtaatatgttttctaatgactttaattttgaaaaccaatttgatgaacaagtttcggagttttgttcgaaaatgaaccaggtatgtggaacaaggcaatgtcccattcccaagaaacccatctcggctcttgataaagaagttttcgcgtcatcttctatactaagttcaaattctcctgctttaacaaatacttgggaatcacattctaatattacagataatactcctgctaatgtcactgctactgatgctactaaatatgaaaattccttctccggttttggccgacttggtttcgatatgagtgccaatcattacgtcgtgaatgataatagcactggtagcactgatagcactggtagcactgatagcactggtagcactggcaataagaacaaaaagaacaataataatagcgatgatgtactcccattcatatccgagtcaccgtttgatatgaaccaagttactaatttttttagtccgggatctaccggcatcggcaataatgctgcctctaacaccaatcccagcctactgcaaagcagcaaagaggatataccttttatcaacgcaaatctggctttcccagacgacaattcaactaatattcaattacaacctttctctgaatctcaatctcaaaataagtctgactacgacatgttttttagagattcatcgaaggaaggtaacaatttatttggagagtttttagaggatgacgatgatgacaaaaaagccgctaatatgtcagacgatgagtcaagtttaatcaagaaccagttaattaacgaagaaccagagcttccgaaacaatatctacaatcggtaccaggaaatgaaagcgaaatctcacaaaaaaatggcagtagtttacagaatgctgacaagatcaataatggtaatgataacgataatgataatgatgtcgttccatctaaggaaggctctttactaaggtgttcggaaatttgggatagaataacaacacatccgaaatactcagatattgatgtcgatggtttatgttccgagctaatggcaaaggcaaaatgttcagaaagaggggttgtcatcaatgcagaagacgttcaattagctttgaataagcatatgaactaa

SEQ ID NO: 4 - protein, 656 aa, Saccharomyces cerevisiae
MSVSTAKRSLDVVSPGSLAEFEGSKSRHDEIENEHRRTSTRDGEDSEQPKKKGSKTSKKQDLDPETKQKRTAQNRAAQRAFRERKERKMKELEKKVQSLESIQQQNEVEATFLRDQLITLVNELKKYRPETRNDSKVLEYLARRDPNLHFSKNNVNHSNSEPIDTPNDDIQENVKQKMNFTFQYPLDNDNDNDYSKNVGKQLPSPNDPSHSAPMPINQTQKKLSDATDSSSATLDSLSNSNDVLNNTPNSSTSMDWLDNVIYTNRFVSGDDGSNSKTKNLDSNMFSNDFNFENQFDEQVSEFCSKMNQVCGTRQCPIPKKPISALDKEVFASSSILSSNSPALTNTWESHSNITDNTPANVTATDATKYENSFSGFGRLGFDMSANHYVVNDNSTGSTDSTGSTDSTGSTGNKNKKNNNNSDDVLPFISESPFDMNQVTNFFSPGSTGIGNNAASNTNPSLLQSSKEDIPFINANLAFPDDNSTNIQLQPFSESQSQNKSDYDMFFRDSSKEGNNLFGEFLEDDDDDKKAANMSDDESSLIKNQLINEEPELPKQYLQSVPGNESEISQKNGSSLQNADKINNGNDNDNDNDVVPSKEGSLLRCSEIWDRITTHPKYSDIDVDGLCSELMAKAKCSERGVVINAEDVQLALNKHMN

SEQ ID NO: 5 - DNA, 1953 bp, Saccharomyces cerevisiae
atgagtgtgtctamcgccaagaggtcgctggatgtcgtttctccgggttcattagcggagtttgagggttcaaaatctcgtcacgatgaaatagaaaatgaacatagacgtactggtacacgtgatggcgaggatagcgagcaaccgaagaagaagggtagcaaaactagcaaaaagcaagatttggatcctgaaactaagcagaagaggactgcccaaaatcgggccgctcaaagagcttttagggaacgtaaggagaggaagatgaaggaattggagaagaaggtacaaagtttagagagtattcagcagcaaaatgaagtggaagctacttttttgagggaccagttaatcactctggtgaatgagttaaaaaaatatagaccagagacaagaaatgactcaaaagtgctggaatatttagcaaggcgagatcctaatttgcatttttcaaaaaataacgttaaccacagcaatagcgagccaattgacacacccaatgatgacatacaagaaaatgttaaacaaaagatgaatttcacgtttcaatatccgcttgataacgacaacgacaacgacaacagtaaaaatgtggggaaacaattaccttcaccaaatgatccaagtcattcggctcctatgcctataaatcagacacaaaagaaattaagtgacgctacagattcctccagcgctactttggattccctttcaaatagtaacgatgttcttaataacacaccaaactcctccacttcgatggattggttagataatgtaatatatactaacaggtttgtgtcaggtgatgatggcagcaatagtaaaactaagaatttagacagtaatatgttttctaatgactttaattttgaaaaccaatttgatgaacaagtttcggagttttgttcgaaaatgaaccaggtatgtggaacaaggcaatgtcccattcccaagaaacccatctcggctcttgataaagaagttttcgcgtcatcttctatactaagttcaaattctcctgctttaacaaatacttgggaatcacattctaatattacagataatactcctgctaatgtcattgctactgatgctactaaatatgaaaattccttctccggttttggccgacttggtttcgatatgagtgccaatcattacgtcgtgaatgataatagcactggtagcactgatagcactggtagcactggcaataagaacaaaaagaacaataataatagcgatgatgtactcccattcatatccgagtcaccgtttgatatgaaccaagttactaatttttttagtccgggatctaccggcatcggcaataatgctgcctctaacaccaatcccagcctactgcaaagcagcaaagaggatataccttttatcaacgcaaatctggctttcccagacgacaattcaactaatattcaattacaacctttctctgaatctcaatctcaaaataagtttgactacgacatgttttttagagattcatcgaaggaaggtaacaatttatttggagagtttttagaggatgacgatgatgamaaaaaagccgctaatatgtcagacgatgagtcaagtttaatcaagaaccagttaattaacgaagaaccagagcttccgaaacaatatctacaatcggtaccaggaaatgaaagcgaaatctcacaaaaaaatggcagtagtttacagaatgctgacaaaatcaataatggcaatgataacgataatgataatgatgtcgttccatctaaggaaggctctttactaaggtgttcggaaatttgggatagaataacaacacatccgaaatactcagatattgatgtcgatggtttatgttccgagctaatggcaaaggcaaaatgttcagaaagaggggttgtcatcaatgcagaagacgttcaattagctttgaataagcatatgaactaa

SEQ ID NO: 6 - protein, 650 aa, Saccharomyces cerevisiae
  misc_feature (5)..(5): Xaa can be any naturally occurring amino acid
  misc_feature (521)..(521): Xaa can be any naturally occurring amino acid
MSVSXAKRSLDVVSPGSLAEFEGSKSRHDEIENEHRRTGTRDGEDSEQPKKKGSKTSKKQDLDPETKQKRTAQNRAAQRAFRERKERKMKELEKKVQSLESIQQQNEVEATFLRDQLITLVNELKKYRPETRNDSKVLEYLARRDPNLHFSKNNVNHSNSEPIDTPNDDIQENVKQKMNFTFQYPLDNDNDNDNSKNVGKQLPSPNDPSHSAPMPINQTQKKLSDATDSSSATLDSLSNSNDVLNNTPNSSTSMDWLDNVIYTNRFVSGDDGSNSKTKNLDSNMFSNDFNFENQFDEQVSEFCSKMNQVCGTRQCPIPKKPISALDKEVFASSSILSSNSPALTNTWESHSNITDNTPANVIATDATKYENSFSGFGRLGFDMSANHYVVNDNSTGSTDSTGSTGNKNKKNNNNSDDVLPFISESPFDMNQVTNFFSPGSTGIGNNAASNTNPSLLQSSKEDIPFINANLAFPDDNSTNIQLQPFSESQSQNKFDYDMFFRDSSKEGNNLFGEFLEDDDDXKKAANMSDDESSLIKNQLINEEPELPKQYLQSVPGNESEISQKNGSSLQNADKINNGNDNDNDNDVVPSKEGSLLRCSEIWDRITTHPKYSDIDVDGLCSELMAKAKCSERGVVINAEDVQLALNKHMN

SEQ ID NO: 7 - protein, 656 aa, Saccharomyces cerevisiae
MSVSTAKRSLDVVSPGSLAEFEGSKSRHDEIENEHRRTGTRDGEDSEQPKKKGSKTSKKQDLDPETKQKRTAQNRAAQRAFRERKERKMKELEKKVQSLESIQQQNEVEATFLRDQLITLVNELKKYRPETRNDSKVLEYLARRDPNLLFSKNNVNHSNSEPIDTPNDDIQENVKQKMNFTFQYPLDNDNDNDDSKNVGKQLPSPNDPSHSAPMPINQTQKKLSDATDSSSATLDSLSNSNDVLNNTPNSSTSMDWLDNVIYTNRFVSGDDGSNSKTKNLDSNMFSNDFNFENQFDEQVSEFCSKMNQVCGTRQCPIPKKPISALDKEVFASSSILSSNSPALTNTWESHSNITDNTPANVIATDATKYENSFSGFGRLGFDMSANHYVVNDNSTGSTDSTDSTGSTGSTGNKNKKNNNNSDDVLPFISESPFDMNQVTNFFSPGSTGIGNNAASNTNPSLLQSSKEDIPFINANLAFPDDNSTNIQLQPFSESQSQNKFDYDMFFRDSSKEGNNLFGEFLEDDDDDKKAANMSDDESSLIKNQLINEEPELPKQYLQSVPGNESEISQKNGSSLQNADKINNGNDNDNDNDVVPSKEGSLLRCSEIWDRITTHPKYSDIDVDGLCSELMAKAKCSERGVVINAEDVQLALNKHMN

SEQ ID NO: 8 - protein, 656 aa, Saccharomyces cerevisiae
MSVSTAKRSLDVVSPGSLAEFEGSKSRHDEIENEHRRTSTRDGEDSEQPKKKGSKTSKKQDLDPETKQKRTAQNRAAQRAFRERKERKMKELEKKVQSLESIQQQNEVEATFLRDQLITLVNELKKYRPETRNDSKVLEYLARRDPNLHFSKNNVNHSNSEPIDTPNDDIQENVKQKMNFTFQYPLDNDNDNDYSKNVGKQLPSPNDPSHSAPMPINQTQKKLSDATDSSSATLDSLSNSNDVLNNTPNSSTSMDWLDNVIYTNRFVSGDDGSNSKTKNLDSNMFSNDFNFENQFDEQVSEFCSKMNQVCGTRQCPIPKKPISALDKEVFASSSILSSNSPALTNTWESHSNITDNTPANVTATDATKYENSFSGFGRLGFDMSANHYVVNDNSTGSTDSTGSTDSTGSTGNKNKKNNNNSDDVLPFISESPFDMNQVTNFFSPGSTGIGNNAASNTNPSLLQSSKEDIPFINANLAFPDDNSTNIQLQPFSESQSQNKFDYDMFFRDSSKEGNNLFGEFLEDDDDDKKAANMSDDESSLIKNQLINEEPELPKQYLQSVPGNESEISQKNGSSLQNADKINNGNDNDNDNDVVPSKEGSLLRCSEIWDRITTHPKYSDIDVDGLCSELMAKAKCSERGVVINAEDVQLALNKHMN

SEQ ID NO: 9 - protein, 523 aa, Saccharomyces cerevisiae
  misc_feature (149)..(149): Xaa can be any naturally occurring amino acid
MSVSTAKRSLDVVSPGSLAEFEGSKSRHDEIENEHRRTGTRDGEDSEQPKKKGSKTSKKQDLDPETKQKRTAQNRAAQRAFRERKERKMKELEKKVQSLESIQQQNEVEATFLRDQLITLVNELKKYRPETRNDSKVLEYLARRDPNLXFSKNNVNHSNSEPIDTPNDDIQENVKQKMNFTFQYPLDNDNDNDDSKNVGKQLPSPNDPSHSAPMPINQTQKKLSDATDSSSATLDSLSNSNDVLNNTPNSSTSMDWLDNVIYTNRFVSGDDGSNSKTKNLDSNMFSNDFNFENQFDEQVSEFCSKMNQVCGTRQCPIPKKPISALDKEVFASSSILSSNSPALTNTWESHSNITDNTPANVIATDATKYENSFSGFGRLGFDMSANHYVVNDNSTGSTDSTDSTGSTGSTGNKNKKNNNNSDDVLPFISESPFDMNQVTNFFSPGSTGIGNNAASNTNPSLLQSSKEDIPFINANLAFPDDNSTNIQLQPFSESQSQNKFDYDMFFRDSSKEGNNLFGEFFRG

SEQ ID NO: 10 - protein, 600 aa, Saccharomyces cerevisiae
  misc_feature (149)..(149): Xaa can be any naturally occurring amino acid
MSVSTAKRSLDVVSPGSLAEFEGSKSRHDEIENEHRRTGTRDGEDSEQPKKKGSKTSKKQDLDPETKQKRTAQNRAAQRAFRERKERKMKELEKKVQSLESIQQQNEVEATFLRDQLITLVNELKKYRPETRNDSKVLEYLARRDPNLXFSKNNVNHSNSEPIDTPNDDIQENVKQKMNFTFQYPLDNDNDNDDSKNVGKQLPSPNDPSHSAPMPINQTQKKLSDATDSSSATLDSLSNSNDVLNNTPNSSTSMDWLDNVIYTNRFVSGDDGSNSKTKNLDSNMFSNDFNFENQFDEQVSEFCSKMNQVCGTRQCPIPKKPISALDKEVFASSSILSSNSPALTNTWESHSNITDNTPANVIATDATKYENSFSGFGRLGFDMSANHYVVNDNSTGSTDSTDSTGSTGSNKNKKNNNNSDDVLPFISESPFDMNQVTNFFSPGSTGIGNNAASNTNPSLLQSSKEDIPFINANLAFPDDNSTNIQLQPFSESQSQNKFDYDMFFRDSSKEGNNLFGEFLEDDDDDKKAANMSDDESSLIKNQLINEEPELPKQYLQSVPGNEKRNLTKKMAVVCRMLTRSIMAMITIMITMSFHLRKALY

SEQ ID NO: 11 - protein, 650 aa, Saccharomyces cerevisiae
MSVSTAKRSLDVVSPGSLAEFEGSKSRHDEIENEHRRTGTRDGEDSEQPKKKGSKTSKKQDLDPETKQKRTAQNRAAQRAFRERKERKMKELEKKVQSLESIQQQNEVEATFLRDQLITLVNELKKYRPETRNDSKVLEYLARRDPNLHFSKNNVNHSNSEPIDTPNDDIQENVKQKMNFTFQYPLDNDNDNDNSKNVGKQLPSPNDPSHSAPMPINQTQKKLSDATDSSSATLDSLSNSNDVLNNTPNSSTSMDWLDNVIYTNRFVSGDDGSNSKTKNLDSNMFSNDFNFENQFDEQVSEFCSKMNQVCGTRQCPIPKKPISALDKEVFASSSILSSNSPALTNTWESHSNITDNTPANVIATDATKYENSFSGFGRLGFDMSANHYVVNDNSTGSTDSTGSTGNKNKKNNNNSDDVLPFISESPFDMNQVTNFFSPGSTGIGNNAASNTNPSLLQSSKEDIPFINANLAFPDDNSTNIQLQPFSESQSQNKFDYDMFFRDSSKEGNNLFGEFLEDDDDDKKAANMSDDESSLIKNQLINEEPELPKQYLQSVPGNESEISQKNGSSLQNADKINNGNDNDNDNDVVPSKEGSLLRCSEIWDRITTHPKYSDIDVDGLCSELMAKAKCSERGVVINAEDVQLALNKHMN

SEQ ID NO: 12 - protein, 409 aa, Saccharomyces cerevisiae
MGNILRKGQQIYLAGDMKKQMLLNKDGTPKRKVGRPGRKRIDSEAKSRRTAQNRAAQRAFRDRKEAKMKSLQERVELLEQKDAQNKTTTDFLLCSLKSLLSEITKYRAKNSDDERILAFLDDLQEQQKRENEKGTSTAVSKAAKELPSPNSDENMTVNTSIEVQPHTQENEKVMWNIGSWNAPSLTNSWDSPPGNRTGAVTIGDESINGSEMPDFSLDLVSNDRQTGLEALDYDIHNYFPQHSERLTAEKIDTSACQCEIDQKYLPYETEDDTLFPSVLPLAVGSQCNNICNRKCIGTKPCSNKEIKCDLITSHLLNQKSLASVLPVAASHTKTIRTQSEAIEHISSAISNGKASCYHILEEISSLPKYSSLDIDDLCSELIIKAKCTDDCKIVVKARDLQSALVRQLL

SEQ ID NO: 13 - protein, 569 aa, Saccharomyces cerevisiae
MKLKTVRSAVLSSLFASQVLGKIIPAANKRDDDSNSKFVKLPFHKLYGDSLENVGSDKKPEVRLLKRADGYEEIIITNQQSFYSVDLEVGTPPQNVTVLVDTGSSDLWIMGSDNPYCSSNSMGSSRRRVIDKRDDSSSGGSLINDINPFGWLTGTGSAIGPTATGLGGGSGTATQSVPASEATMDCQQYGTFSTSGSSTFRSNNTYFSISYGDGTFASGTFGTDVLDLSDLNVTGLSFAVANETNSTMGVLGIGLPELEVTYSGSTASHSGKAYKYDNFPIVLKNSGAIKSNTYSLYLNDSDAMHGTILFGAVDHSKYTGTLYTIPIVNTLSASGFSSPIQFDVTINGIGISDSGSSNKTLTTTKIPALLDSGTTLTYLPQTVVSMIATELGAQYSSRIGYYVLDCPSDDSMEIVFDFGGFHINAPLSSFILSTGTTCLLGIIPTSDDTGTILGDSFLTNAYVVYDLENLEISMAQARYNTTSENIEIITSSVPSAVKAPGYTNTWSTSASIVTGGNIFTVNSSQTASFSGNLTTSTASATSTSSKRNVGDHIVPSLPLTLISLLFAFI

SEQ ID NO: 14 - protein, 295 aa, Saccharomyces cerevisiae
MLMQIKMDNHPFNFQPILASHSMTRDSTKPKKMTDTAFVPSPPVGFIKEENKADLHTISVVASNVTLPQIQLPKIATLEEPGYESRTGSLTDLSGRRNSVNIGALCEDVPNTAGPHIARPVTINNLIPPSLPRLNTYQLRPQLSDTHLNCHFNSNPYTTASHAPFESSYTTASTFTSQPAASYFPSNSTPATRKNSATTNLPSEERRRVSVSLSEQVFNEGERYNNDGQLIGKTGKPLRNTKRAAQNRSAQKAFRQRREKYIKNLEEKSKLFDGLMKENSELKKMIESLKSKLKE

SEQ ID NO: 15 - protein, 245 aa, Saccharomyces cerevisiae
MALPLIKPKESEESHLALLSKIHVSKNWKLPPRLPHRAAQRRKRVHRLHEDYETEENDEELQKKKRQNRDAQRAYRERKNNKLQVLEETIESLSKVVKNYETKLNRLQNELQAKESENHALKQKLETLTLKQASVPAQDPILQNLIENFKPMKAIPIKYNTAIKRHQHSTELPSSVKCGFCNDNTTCVCKELETDHRKSDDGVATEQKDMSMPHAECNNKDNPNGLCSNCTNIDKSCIDIRSIIH

SEQ ID NO: 16 - protein, 383 aa, Saccharomyces cerevisiae
MQNPPLIRPDMYNQGSSSMATYNASEKNLNEHPSPQIAQPSTSQKLPYRINPTTTNGDTDISVNSNPIQPPLPNLMHLSGPSDYRSMHQSPIHPSYIIPPHSNERKQSASYNRPQNAHVSIQPSVVFPPKSYSISYAPYQINPPLPNGLPNQSISLNKEYIAEEQLSTLPSRNTSVTTAPPSFQNSADTAKNSADNNDNNDNVTKPVPDKDTQLISSSGKTLRNTRRAAQNRTAQKAFRQRKEKYIKNLEQKSKIFDDLLAENNNFKSLNDSLRNDNNILIAQHEAIRNAITMLRSEYDVLCNENNMLKNENSIIKNEHNMSRNENENLKLENKRFHAEYIRMIEDIENTKRKEQEQRDEIEQLKKKIRSLEEIVGRHSDSAT

SEQ ID NO: 17 - protein, 245 aa, Saccharomyces cerevisiae
MRQRRSVVAVSVKPKGFKLGHKQGSMSTTSPPPSSPDGNVSTSGPSAIKLSKNWELPQRLKPGRKPKSKRGDASANNDGSSKIKKVQTSNQKDQMTTKDHENEGAKGHEGKSDDEGNGSGDENGVDSVEKRRRQNRDAQRAYRERRTTRIQVLEEKVEMLHNLVDDWQRKYKLLESEFSDTKENLQKSIALNNELQKALPLIVNTPFQQQPENPPDNPISILEMVENFKPIGAVSLKKGKLKAHC

SEQ ID NO: 18 - protein, 294 aa, Saccharomyces cerevisiae
MAKPRGRKGGRKPSLTPPKNKRAAQLRASQNAFRKRKLERLEELEKKEAQLTVTNDQIHILKKENELLHFMLRSLLTERNMPSDERNISKACCEEKPPTCNTLDGSVVLSSTYNSLEIQQCYVFFKQLLSVCVGKNCTVPSPLNSFDRSFYPIGCTNLSNDIPGYSFLNDAMSEIHTFGDFNGELDSTFLEFSGTEIKEPNNFITENTNAIETAAASMVIRQGFHPRQYYTVDAFGGDVLLSAMDIWSFMKVHPKVNTFDLEILGTELKKSATCSNFDILISLKHFIKVFSSKL

SEQ ID NO: 19 - DNA, 1953 bp, Artificial Sequence
  B5-1 variant
ttagttcatatgcttattcaaagctaattgaacgtcttctgcattgatgacaacccctctttctgaacattttgcctttgccattagctcggaacataaaccatcgacatcaatatctgagtatttcggatgtgttgttattctatcccaaatttccgaacaccttagtaaagagccttccttagatggaacgacatcattatcattatcgttatcattgccattattgattttgtcagcattctgtaaactactgccatttttttgtgagatttcgctttcatttcctggtaccgattgtagatattgtttcggaagctctggttcttcgttaattaactggttcttgattaaacttgactcatcgtctgacatattagcggcctttttgtcatcatcgtcatcctctaaaaactctccaaataaattgttaccttccttcgatgaatctctaaaaaacatgtcgtagtcaaacttattttgagattgagattcagagaaaggttgtaattgaatattagttgaattgtcgtctgggaaagccagatttgcgttgataaaaggtatatcctctttgctgctttgcagtaggctgggattggtgttagaggcagcattattgccgatgccggtagatcccggactaaaaaaattagtaacttggttcatatcaaacggtgactcggatatgaatgggagtacatcatcgctattattattgttctttttgttcttattgccagcgctaccagtgctatcagtgctaccagtgctattatcattcacgacgtaatgattggcactcatatcgaaaccaagtcggccaaaaccggagaaggaattttcatatttagtagcatcagtagcaatgacattagcaggagtattatctgtaatattagaatgtgattcccaagtatttgttaaagcaggagaatttgaacttagtatagaagatgacgcgaaaacttctttatcaagagccgagatgggtttcttgggaatgggacattgccttgttccacatacctggttcattttcgaacaaaactccgaaacttgttcatcaaattggttttcaaaattaaagtcattagaaaacatattactgtctaaattcttagttttactattgctgccatcatcacctgacacaaacctgttagtatatattacattatctaaccaatccaccgaagtggaggagtttggtgtgttattaagaacatcgttactatttgaaagggaatccaaagtagcgctggaggaatctgtagcgtcacttaatttcttttgtgtctgatttataggcataggagccgaatgacttggatcatttggtgaaggtaattgtttccccacatttttactgttgtcgttgtcgttgtcgttatcaagcggatattgaaacgtgaaattcatcttttgtttaacattttcttgtatgtcatcattgggtgtgtcaattggctcgctattgctgtggttaacgttattttttgaaaaatgcaaattaggatctcgccttgctaaatattccagcacttttgagtcatttcttgtctctggtctatatttttttaactcattcaccagagtgattaactggtccctcaaaaaagtagcttccacttcattttgctgctgaatactctctaaactttgtaccttcttctccaattccttcatcttcctctccttacgttccctaaaagctctttgagcggcccgattttgggcagtcctcttctgcttagtttcaggatccaaatcttgctttttgctagttttgctacccttcttcttcggttgctcgctatcctcgccatcacgtgtaccagtacgtctatgttcattttctatttcatcgtgacgagattttgaaccctcaaactccgctaatgaacccggagaaacgacatccagcgacctcttggcggtagacacactcat

SEQ ID NO: 20 - DNA, 1953 bp, Artificial Sequence
  B5-4 variant
ttagttcatatgcttattcaaagctaattgaacgtcttctgcattgatgacaacccctctttctgaacattttgcctttgccattagctcggaacataaaccatcgacatcaatatctgagtatttcggatgtgttgttattctatcccaaatttccgaacaccttagtaaagagccttccttagatggaacgacatcattatcattatcgttatcattgccattattgattttgtcagcattctgtaaactactgccatttttttgtgagatttcgctttcatttcctggtaccgattgtagatattgtttcggaagctctggttcttcgttaattaactggttcttgattaaacttgactcatcgtctgacatattagcggcttttttgtcatcatcgtcatcctctaaaaactctccaaataaattgttaccttccttcgatgaatctctaaaaaacatgtcgtagtcaaacttattttgagattgagattcagagaaaggttataattgaatattagttgaattgtcgtctgggaaagccagatttgcgttgataaaaggtatatcctctttgctgctttgcagtaggctgggattggtgttagaggcagcattattgcagatgccggtagatcccggactaaaaaaattagtaacttggttcatatcaaacggtgactcggatatgaatgggagtacatcatcgctattattattgttctttttgttcttattgccagtgctaccagtgctatcagtgctaccagtgctattatcattcacgacgtaatgattggcactcatatcgaaaccaagtcggccaaaaccggagaaggaattttcatatttagtagcatcagtagcaatgacattagcaggagtattatctgtaatattagaatgtgattcccaagtatttgttaaagcaggagaatttgaacttagtatagaagatgacgcgaaaacttctttatcaagagccgagatgggtttcttgggaatgggacattgccttgttccacatacctggttcattttcgaacaaaactccgaaacttgttcatcaaattggttttcaaaattaaagtcattagaaaacatattactgtctaaattcttagttttactattgctgccatcatcacctgacacaaacctgttagtatatattacattatctaaccaatccatcgaagtggaggagtttggtgtgttattaagaacatcgttactatttgaaagggaatccaaagtagcgctggaggaatctgtagcgtcacttaatttcttttgtgtctgatttataggcataggagccgaatgacttggatcatttggtgaaggtaattgtttccccacatttttactgttgtcgttgtcgttgtcgttatcaagcggatattgaaacgtgaaattcatcttttgtttaacattttcttgtatgtcatcattgggtgtgtcaattggctcgctattgctgtggttaacgttattttttgaaaaatgcaaattaggatctcgccttgctaaatattccagcacttttgagtcatttcctgtctctggtctatatttttttaactcattcaccagagtgattaactggtccctcaaaaaagtagcttccacttcattttgctgctgaatactctctaaactttgtaccttcttctccaattccttcatcttcctctccttacgttccctaaaaactctttgagcggcccgattttgggcagtcctcttctgcttagtttcaggatccaaatcttgctttttgctagttttgctacccttcttcttcggttgctcgctatcctcgccatcacgtgtaccagtacgcctatgttcattttctatttcatcgtgacgagattttgaaccctcaaactccgctaatgaacccggagaaacgacatccagcgacctcttggcggtagacacactcat

SEQ ID NO: 21 - DNA, 1953 bp, Artificial Sequence
  B8-1 variant
ttagttcatatgcttattcaaagctaattgaacgtcttctgcattgatgacaacccctctttctgaacattttgcctttgccattagctcggaacataaaccatcgacatcaatatctgagtatttcggatgtgttgttattctatcccaaatttccgaacaccttagtaaagagccttccttagatggaacgacatcattatcattatcgttatcattgccattattgattttgtcagcattctgtaaactactgccatttttttgtgagatttcgctttcatttcctggtaccgattgtagatattgtttcggaagctctggttcttcgttaattaactggttcttgattaaacttgactcatcgtctgacatattagcggcttttttgtcatcatcgtcatcctctaaaaactctccaaataaattgttaccttccttcgatgaatctctaaaaaacatgtcgtagtcaaacttattttgagattgagattcagagaaaggttgtaattgaatattagttgaattgtcgtctgggaaagccagatttgcgttgataaaaggtatatcctctttgctgctttgcagtaggctgggattggtgttagaggcagcattattgccgatgccggtagatcccggactaaaaaaattagtaacttggttcatatcaaacggtgactcggatatgaatgggagtacatcatcgctattattattgttctttttgttcttattgccagtgctaccagtgctatcagtgctaccagtgctattatcattcacgacgtaatgattggcactcatatcgaaaccaagtcggccaaaaccggagaaggaattttcatatttagtagcatcagtagcaatgacattagcaggagtattatctgtaatattagaatgtgattcccaagtatttgttaaagcaggagaatttgaacttagtatagaagatgacgcgaaaacttctttatcaagagccgagatgggtttcttgggaatgggacattgccttgttccacatacctggttcattttcgaacaaaactccgaaacttgttcatcaaattggttttcaaaattaaagtcattagaaaacatattactgtctaaattcttagttttactattgctgccatcatcacctgacacaaacctgttagtatatattacattatctaaccaatccatcgaagtggaggagtttggtgtgttattaagaacatcgttactatttgaaagggaatccaaagtagcgctggaggaatctgtagcgtcacttaatttcttttgtgtctgatttataggcataggagccgaatgacttggatcatttggtgaaggtaattgtttccccacatttttactgttgtcgttgtcgttgtcgttatcaagcggatattgaaacgtgaaattcatcttttgtttaacattttcttgtatgtcaccattgggtgtgtcaattggctcgctattgctgtggttaacgttattttttgaaaaatgcaaattaggatctcgccttgctaaatattccagcacttttgagtcatttcttgtctctggtctatatttttttaactcattcaccagagtgattaactggtccctcaaaaaagtagcttccacttcattttgctgctgaatactctctaaactttgtaccttcttctccaattccttcatcttcctctccttacgttccctaaaagctctttgagcggcccgattttgggcagtcctcttctgcttagtttcaggatccaaatcttgctttttgctagttttgctacccttcttcttcggttgctcgctatcctcgccatcacgtgtaccagtacgtctatgttcattttctatttcatcgtgacgagattttgaaccctcaaactccgctaatgaacccggagaaacgacatccagcgacctcttggcggtagacacactcat

SEQ ID NO: 22 - DNA, 1953 bp, Artificial Sequence
  B8-4 variant
ttagttcatatgcttattcaaagctaattgaacgtcttctgcattgatgacaacccctctttctgaacattttgcctttgccattagctcggaacataaaccattgacatcaatatctgagtatttcggatgtgttgttattctatcccaaatttccgaacaccttagtaaagagccttccttagatggaacgacatcattatcattatcgttatcattgccattattgattttgtcagcattctgtaaactactgccatttttttgtgagatttcgctttcatttcctggtaccgattgtagatattgtttcggaagctctggttcttcgttaattaactggttcttgattaaacttgactcatcgtctgacatattagcggcttttttgtcatcatcgtcatcctctaaaaactctccaaataaattgttaccttccttcgatgaatctctaaaaaacatgtcgtagtcaaacttattttgagattgagatttagagaaaggttgtaattgaatattagttgaattgtcgtctgggaaagccagatttgcgttgataaaaggtatatcctctttgctgctttgcagtaggctgggattggtgttagaggcagcattattgccgatgccggtagatcccggactaaaaaaattagtaacttggttcatatcaaacggtgactcggatatgaatgggagtacatcatcgctattattattgttctttttgttcttattgccagtgctaccagtgctatcagtgctaccagtgctattatcattcacgacgtaatgattggcactcatatcgaaaccaagtcggccaaaaccggagaaggaattttcatatttagtagcatcagtagcaatgacattagcaggagtattatctgtaatattagaatgtgattcccaagtatttgttaaagcaggagaatttgaacttagtatagaagatgacgcgaaaacttctttatcaagagccgagatgggtttcttgggaatgggacattgccttgttccacatacctggttcattttcgaacaaaactccgaaacttgttcatcaaattggttttcaaaattaaagtcattagaaaacatattactgtctaaattcttagttttactattgctgccatcatcacctgacacaaacctgttagtatatattacattatctaaccaatccatcgaagtggaggagtttggtgtgttattaagaacatcgttactatttgaaagggaatccaaagtagcgctggaggaatctgtagcgtcacttaatttcttttgtgtctgatttataggcataggagccgaatgacttggatcatttggtgaaggtaattgtttccccacatttttactgttgtcgttgtcgttgtcgttatcaagcggatattgaaacgtgaaattcatcttttgtttaacattttcttgtatgtcatcattgggtgtgtcaattggctcgctattgctgtggttaacgttattttttgaaaaatgcaaattaggatctcgccttgctaaatattccagcacttttgagtcatttcttgtctctggtctatatttttttaactcattcaccagagtgattaactggtccctcaaaaaagtagcttccacttcattttgctgctgaatactctctaaactttgtaccttcttctccaattccttcatcttcctctccttacgttccctaaaagctctttgagcggcccgattttgggcagtcctcttctgcttagtttcaggatccaaatcttgctttttgctagttttgctacccttcttcttcggttgctcgctatcctcgccatcacgtgtaccagtacgtctatgttcattttctatttcatcgtgacgagattttgaaccctcaaactccgctaatgaacccggagaaacgacatccagcgacctcttggcggtagacacactcat

SEQ ID NO: 23 - DNA, 1953 bp, Artificial Sequence
  C5-2 variant
atgagtgtgtctaccgccaagaggtcgctggatgtcgtttctccgggttcattagcggagtttgagggttcaaaatctcgtcacgatgaaatagaaaatgaacatagacgtactggtacacgtgatggcgaggatagcgagcaaccgaagaagaagggtagcaaaactagcaaaaagcaagatttggatcctgaaactaagcagaagaggactgcccaaaatcgggccgctcaaagagcttttagggaacgtaaggagaggaagatgaaggaattggagaagaaggtacaaagtttagagagtattcagcagcaaaatgaagtggaagctacttttttgagggaccagttaatcactctggtgaatgagttaaaaaaatacagaccagagacaagaaatgactcaaaagtgctggaatatttagcaaggcgagatcctaatttgcatttttcaaaaaataacgttaaccacagcaatagcgagccaattgacacacccaatgatgacatacaagaaaatgttaaacaaaagatgaatttcacgtttcaatatccgcttgataacgacaacgacaacgacaacagtaaaaatgtggggaaacaattaccttcaccaaatgatccaagtcactcggctcctatgcctataaatcagacacaaaagaaattaagtgacgctacagattcctccagcgctactttggattccttttcaaatagtaacgatgttcttaataacacaccaaactcctccacttcgatggattggttagataatgtaatatatactaacaggtttgtgtcaggtgatgatggcagcaatagtaaaactaagaatttagacagtaatatgttttctaatgactttaattttgaaaaccaatttgataaacaagtttcggagttttgttcgaaaatgaaccaggtatgtggaacaaggcaatgtcccattcccaagaaacccatctcggctcttgataaagaagttttcgcgtcatcttctatactaagttcaaattctcctgctttaacaaatacttgggaatcacattctaatattacagataatactcctgctaatgtcattgctactgatgctattaaatatgaaaattccttctccggttttggccgacttggtttcgatatgagtgccaatcattacgtcgtgaatgataatagcactggtagcactgatagcactggtagcactggcaataagaacaaaaagaacaataataatagcgatgatgtactcccattcatatccgagtcgccgtttgatatgaaccaagttactaatttttttagtccgggatctaccggcatcggcaataatgctgcctctaacaccaatcccagcctactgcaaagcagcaaagaggatataccttttatcaacgcaaatctggctttcccagacgacaattcaactaatattcaattacaacctttctctgaatctcaatctcaaaataagtttgactacgacatgctttttagagattcatcgaaggaaggtaacaatttatttggagagtttttagaggatgacgatgatgacaaaaaagccgctaatatgtcagacgatgagtcaagtttaatcaagaaccagttaattaacgaagaaccagagcttccgaaacaatatctacaatcggtaccaggaaatgaaagcgaaatctcacaaaaaaatggcagtagtttacagaatgctgacaaaatcaataatggcaatgataacgataatgataatgatgtcgttccatctaaggaaggctctttactaaggtgttcggaaatttgggatagaataacaacacatccgaaatactcagatattgatgtcgatggtttatgttccgagctaatggcaaaggcaaaatgttcagaaagaggggttgtcatcaatgcagaagacgttcaattagctttgaacaagcatatgaactaa

SEQ ID NO: 24 - DNA, 1953 bp, Artificial Sequence
  C5-3 variant
atgagtgtgtctaccgccaagaggtcgctggatgtcgtttctccgggttcattagcggagtttgagggttcaaaatctcgtcacgatgaaatagaaaatgaacatagacgtactggcacacgtgatggcgaggatagcgagcaaccgaagaagaagggtagcaaaactagcaaaaagcaagatttggatcctgaaactaagcagaagaggactgcccaaaatcgggccgctcaaagagcttttagggaacgtaaggagaggaagatgaaggaattggagaagaaggtacaaagtttagagagtattcagcagcaaaatgaagtggaagctacttttttgagggaccagttaatcactctggtgaatgagttaaaaaaatatagaccagagacaagaaatgactcaaaagtgctggaatatttagcaaggcgagatcctaatttgcatttttcaaaaaataacgttaaccacagcaatagcgagccaattgacacacccaatgatgacatacaagaaaatgttaaacaaaagatgaatttcacgtttcaatatccgcttgataacgacaacgacaacgacaacagtaaaaatgtggggaaacaattaccttcaccaaatgatccaagtcattcggctcctatgcctataaatcagacacaaaagaaattaagtgacgctacagattcctccagcgctactttggattccctttcaaatagtaacgatgttcttaataacacaccaaactcctccacttcgatggattggttagataatgtaatatatactaacaggtttgtgtcaggtgatgatggcagcaatagtaaaactaagaatttagacagtaatatgttttctaatgactttaattttgaaaaccaatttgatgaacaagtttcggagttttgttcgaaaatgaaccaggtatgtggaacaaggcaatgtcccattcccaagaaacccatctcggctcttgataaagaagttttcgcgtcatcttctatactaagttcaaattctcctgctttaacaaatacttgggaatcacattctaatattacagataatactcctgctaatgtcattgctactgatgctactaaatatgaaaattccttctccggttttggccgacttggtttcgatatgagtgccaatcattacgtcgtgaatgataatagcactggtagcactgatagcactggtagcactggcaataagaacaaaaagagcaataataatagcgatgatgtactcccattcatatccgagtcaccgtttgatatgaaccaagttactaatttttttagtccgggatctaccggcatcggcaataatgctgcctctaacaccaatcccagcctactgcaaagcagcaaagaggatataccttttatcaacgcaaatctggctttcccagacgacaattcaactaatattcaattacaacctttctctgaatctcaatctcaaaataagtttgactacgacatgttttttagagattcatcgaaggaaggtaacaatttatttggagagtttttagaggatgacgatgatgacaaaaaagccgctaatatgtcagacgatgagtcaagtttaatcaagaaccagttaattaacgaagaaccagagcttccgaaacaatatctacaatcggtaccaggaaatgaaagcgaaatctcacaaaaaaatggcagtagtttacagaatgccgacaaaatcaataatggcaatgataacgataatggtaatgatgtcgttccatctaaggaaggctctttactaaggtgttcggaaatttgggatagaataacaacacatccgaaatactcagatattgatgtcgatggtttatgttccgagctaatggcaaaggcaaaatgttcagaaagaggggttgtcgtcaatgcagaagacgttcaattagctttgaataagcatatgaactaa

SEQ ID NO: 25 - DNA, 1953 bp, Artificial Sequence
  D8-4 variant
ttagttcatatgcttattcaaagctaattgaacgtcttctgcattgatgacaacccctctttctgaacattttgcctttgccattagctcggaacataaaccatcgacatcaatatctgagtatttcggatgtgttgttattctatcccaaatttccgaacaccttagtaaagagccttccttagatggaacgacatcattatcattatcgttatcattgccattattgattttgtcagcattctgtaaactactgccatttttttgtgagatttcgctttcatttcctggtaccgattgtagatattgtttcggaagctctggttcttcgttaattaactggttcttgattaaacttgactcatcgtctgacatattagcggcttttttgtcatcatcgtcatcctctaaaaactctccaaataaattgttaccttccttcgatgaatctctaaaaaacatgtcgtagtcaaacttattttgagattgagattcagagaaaggttgtaattgaatattagttgaattgtcgtctgggaaagccagatttgcgttgataaaaggtatatcctctttgctgctttgcagtaggctgggattggtgttagaggcagcattattgccgatgccggtagatcccggactaaaaaaattagtaacttggttcatatcaaacggtgactcggatatgaatgggagtacatcatcgctattattattgttctttttgttcttattgccagtgctaccagtgctatcagtgctaccagtgctattatcattcacgacgtaatgattggcactcatatcgaaaccaagtcggccaaaaccggagaaggaattttcatatttagtagcatcagtagcaatgacattagcaggagtattatctgtaatattagaatgtgattcccaagtatttgttaaagcaggagaatttgaacttagtatagaagatgacgcgaaaacttctttatcaagagccgagatgggtttcttgggaatgggacattgccttgttccacatacctggttcattttcgaacaaaactccgaaacttgttcatcaaattggttttcaaaattaaagtcattagaaaacatattactgtctaaattcttagttttactattgctgccatcatcacctgacacaaacctgttagtatatattacattatctgaccaatccatcgaagtggaggagtttggtgtgttattaagaacatcgttactatttgaaagggaatccaaagtagcgctggaggaatctgtagcgtcacttaatttcttttgtgtctgatttataggcataggagccgaatgacttggatcatttggtgaaggtaattgtttccccacatttttactgttgtcgttgtcgttgtcgttatcaagcggatattgaaacgtgaaattcatcttttgtttaacattttcttgtatgtcatcattgggtgtgtcaattggctcgctattgctgtggttaacgttattttttgaaaaatgcaaattaggatctcgccttgctaaatattccagcacttttgagtcatttcttgtctctggtctatatttttttaactcattcaccagagtgattaactggtccctcaaaaaagtagcttccacttcattttgctgctgaatactctctaaactttgtaccttcttctccaattccttcatcttcctctccttacgttccctaaaagctctttgagcggcccgattttgggcagtcctcttctgcttagtttcaggatccaaatcttgctttttgctagttttgctacccttcttcttcggttgctcgctatcctcgccatcacgtgtaccagtacgtctatgttcattttctatttcatcgtgacgagattttgaaccctcaaactccgctaatgaacccggagaaacgacatccagcgacctcttggcggtagacacactcat

SEQ ID NO: 26 - DNA, 1953 bp, Artificial Sequence
  E5-4 variant
atgagtgtgtctaccgccaagaggtcgctggatgtcgtttctccgggttcattagcggagtttgagggttcaaaatctcgtcacgatgaaatagaaaatgaacatagacgtactggtacacgtgatggcgaggatagcgagcaaccgaagaagaagggtagcaaaactagcaaaaagcaagatttggatcctgaaactaagcagaagaggactgcccaaaatcgggccgctcaaagagcttttagggaacgtaaggagaggaagatgaaggaattggagaagaaggtacaaagtttagagagtattcagcagcaaaatgaagtggaagctacttttttgagggaccagttaatcactctggtgaatgagttaaaaaaatatagaccagagacaagaaatgactcaaaagtgctggaatatttagcaaggcgagatcctaatttgcatttttcaaaaaataacgttaaccacagcaatagcgagccaattgacacacccaatgatgacatacaagaaaatgttaaacaaaagatgaatttcacgtttcaatatccgcttgataacgacaacgacaacgacaacagtaaaaatgtggggaaacaattaccttcaccaaatgatccaagtcattcggctcctatgcctataaatcagacacaaaagaaattaagtgacgctacagattcctccagcgctactttggattccctttcaaatagtaacgatgtccttaataacacaccaaactcctccacttcgatggattggttagataatgtaatatatactaacaggtttgtgtcaggtgatgatggcagcaatagtaaaactaagaatttagacagtaatatgttttctaatgactttaattttgaaaaccaatttgatgaacaagtttcggagctttgttcgaaaatgaaccaggtatgtggaacaaggcaatgtcccattcccaagaaacccatctcggctcttgataaagaagttttcgcgtcatcttctatactaagttcaaattctcctgctttaacaaatacttgggaatcacattctaatattacagataatactcctgctaatgtcattgctactgatgctactaaatatgaaaattccttctccggttttggccgacttggtttcgatatgagtgccaatcattacgtcgtgaatgataatagcactggtagcactgatagcactggtagcactggcaataagaacaaaaagaacaataataatagcgatgatgtactcccattcatatccgagtcaccgtttgatatgaaccaagttactaatttttttagtccgggatctaccggcatcggcaataatgctgcctctaacaccaatcccagcctactgcaaagcagcaaagaggatataccttttatcaacgcaaatctggctttcccagacgacaattcaactaatattcaattacaacctttctctgaatctcaatctcaaaataagtttgactacgacacgttttttagagattcatcgaaggaaggtaacaatttatttggagagtttttagaggatgacgatgatgacaaaaaagccgctaatatgtcagacgatgagtcaagtttaatcaagaaccagttaattaacgaagaaccagagcttccgagacaatatctacaatcggtaccaggaaatgaaagcgaaatctcacaaaaaaatggcagtagtttacagaatgctgacaaaatcaataatggcaatgataacgataatgataatgatgtcgttccatctaaggaaggctctctactaaggtgttcggaaatttgggatagaataacaacacatccgaaatactcagatattgatgtcgatggtttatgttccgagctaatggcaaaggcaaaatgttcagaaagaggggttgtcatcaatgcagaagacgttcaattagctttgaataagcatatgaactaa

SEQ ID NO: 27 - DNA, 1953 bp, Artificial Sequence; identical to SEQ ID NO: 26
  F8-1 variant

SEQ ID NO: 28 - DNA, 2025 bp, Saccharomyces cerevisiae
atggaaccaattgatgacttactttttgaggttactgatgcgttcaaaactcagaaggaggatcttcttgagttggtaacattgattgatatatatggcgagcaagttaaccaagaggggagctatgaagaaaagacgagattcattgaaactttgaatacattgttagaggataatccgagtactactggtgaaatcggttgggatctgcctaagggattattgaagttcttgtcaaaggataatgtcgatgtaaatggaagactaggtacgaatatgattgtccaaggtgtaatgaagtgtttctatgccatctcaatccaaggcgagcccaaaaaatgtttaattactgggttggagttgctttcatccctttgttcaaaagatttttccaagagtgatcaacagaataaggaagactttgttgataaaaaggccaatacgttacctcctgaaggagtgatcgaaaattcctctaatcgaaaagattttccatcctacggtgaaagcaagagttcaaatgaatttttcttgaagttgaaatcctacattttatttgaattcataggggcgagtctgaaaaggatttctactctgtttccttcgaaatatctgggagctgctgtgtcaacaattgagaaatttgtgtatagtcatgcggacacttttgaagatgcccttttccttcttcgtagggtgtacacattctgcaggaactatattccccctgatccaccaaaagatatacaattgaacgaagattttactcgagagatgtttgataaagttgtggaggaagaaagtgaattacaggttagactattgcgtaggctttgtacttttggtatttcgacacccataaaaactgtcaccaccaatgccgacgtgaaatactattgtgcactaaatcaacagaagtttgaattatctgcatattacaccgaatatcttgagctattttgcaggtattaccaaatggcgttctcgcttgatgttgatatagagggagaatttcagaatgtgataaaagaatgtaggattatttataagtctgtaccccaggagatttctgctgttaatgatgaagcgaagttggttttggaaagaatggtatataaattggcttatacattcgaagtacaaaaggccgctaaagaaaaaaatgttggtttggactataatggtgtaatattattttctggtatccactatttggaaaccaatcaacatttagtaaaggaaatgaatataacggatgccatttatctctacttgagatttacaactccatcattatattctaaagtttactataatgtagcagttgaatcagttagtcgctactggctatggtatgccattacaaccgagcccttggaggatgtaaaaaaagaattgaagaatctttcagtgtttgttacaaaaacattattgcatgttctacttcaaaagaactgtattcaggtcaatcagcagttaagaatgataactttcactcttctcaccagattactatgtttaatacctgaaaaagttgcatttgagtttatcttagatgtgcttaagacatctccccttccattggctaagacgtccgtattatgtgtttttaaagacctttcaaggcgacgcatctccaccaaggataacgattctgagacggatttgattgtcgaaaaattatccaaactgaaggtcaatgatagtaacaaagctcagcaaagtaacatcagacattatatccaactagattcttccaaaatgaaagctgttcatgactgttgtctgcagactatccaagattcatttacggcagatgccaagaagagtgatatattattactgctaacttacttgaatattttcattgtgctaaaaaaaacatgggatgaagatctactgaagattgtttgttcgaagattgattctaatttgaagtcagtcgaacctgataaacttccgaagtataaggaaattgtggataaaaacgaatctctaaatgactattttactggtataaaatga

SEQ ID NO: 29 - protein, 688 aa, Saccharomyces cerevisiae
MEPIDDLLFEVTDAFKTQKEDLLELVTLIDIYGEQVNQEGSYEEKTRFIETLNTLLEDNPSTTGEIGWDLPKGLLKFLSKDNVDVNGRLGTNMIVQGVMKCFYAISIQGEPKKCLITGLELLSSLCSKDFSKSDQQNKEDFVDKKANTLPPEGVIENSSNRKDFPSYGESKSSNEFFLKLKSYILFEFIGASLKRISTLFPSKYLGAAVSTIEKFVYSHADTFEDALFLLRRVYTFCRNYIPPDPPKDIQLNEDFTREMFDKVVEEESELQVRLLRRLCTFGISTPIKTVTTNADVKYYCALNQQKFELSAYYTEYLELFCRYYQMAFSLDVDIEGEFQNVIKECRIIYKSVPQEISAVNDEAKLVLERMVYKLAYTFEVQKAAKEKNVGLDYNGVILFSGIHYLETNQHLVKEMNITDAIYLYLRFTTPSLYSKVYYNVAVESVSRYWLWYAITTEPLEDVKKELKNLSVFVTKTLLHVLLQKNCIQVNQQLRMITFTLLTRLLCLIPEKVAFEFILDVLKTSPLPLAKTSVLCVFKDLSRRRISTKDNDSETDLIVEKLSKLKVNDSNKAQQSNIRHYIQLDSSKMKAVHDCCLQTIQDSFTADAKKSDILLLLTYLNIFIVLKKTWDEDLLKIVCSKIDSNLKSVEPDKLPKYKEIVDKNESLNDYFTGIKDKNESLNDYFTGIK

SEQ ID NO: 30 - protein, 674 aa, Saccharomyces cerevisiae
MEPIDDILFEVTDAFKTQKEDLLELVTLIDIYGEQVNQEGSYEEKTRFIETLNTLLEDNPSTTGEIGWDLPKGLLKFLSKDNVDVNGRLGTNMIVQGVMKCFYAISIQGEPKKCLITGLELLSSLCSKDFSKSDQQNKEDFVDKKANTLPPEGVIENSSNRKDFPSYGESKSSNEFFLKLKSYILFEFIGASLKRISTLFPSKYLGAAVSTIEKFVYSHADTFEDALFLLRRVYTFCRNYIPPDPPKDIQLNEDFTREMFDKVVEEESELQVRLLRRLCTFGISTPIKTVTTNADVKYYCALNQQKFELSAYYTEYLELFCRYYQMAFSLDVDIEGEFQNVIKECRIIYKSVPQEISAVNDEAKLVLERMVYKLAYTFEVQKAAKEKNVGLDYNGVILFSGIHYLETNQHLVKEMNITDAIYLYLRFTTPSLYSKVYYNVAVESVSRYWLWYAITTEPLEDVKKELKNLSVFVTKTLLHVLLQKNCIQVNQQLRMITFTLLTRLLCLIPEKVAFEFILDVLKTSPLPLAKTSVLCVFKDLSRRRISTKDNDSETDLIVEKLSKLKVNDSNKAQQSNIRHYIQLDSSKMKAVHDCCLQTIQDSFTADAKKSDILLLLTYLNIFIVLKKTWDEDLLKIVCSKIDSNLKSVEPDKLPKYKEIVDKNESLNDYFTGIK

SEQ ID NO: 31 - protein, 104 aa, Saccharomyces cerevisiae
MVTQLKSASEYDSALASGDKLVVVDFFATWCGPCKMIAPMIEKFAEQYSDAAFYKLDVDEVSDVAQKAEVSSMPTLIFYKGGKEVTRVVGANPAAIKQAIASNV

SEQ ID NO: 32 - protein, 678 aa, Saccharomyces cerevisiae
MGLLALGTPLQWFESRTYNEHIRDEGIEQLLYIFQAAGKRDNDPLFWGDELEYMVVDFDDKERNSMLDVCHDKILTELNMEDSSLCEANDVSFHPEYGRYMLEATPASPYLNYVGSYVEVNMQKRRAIAEYKLSEYARQDSKNNLHVGSRSVPLTLTVFPRMGCPDFINIKDPWNHKNAASRSLFLPDEVINRHVRFPNLTASIRTRRGEKVCMNVPMYKDIATPETDDSIYDRDWFLPEDKEAKLASKPGFIYMDSMGFGMGCSCLQVTFQAPNINKARYLYDALVNFAPIMLAFSAAAPAFKGWLADQDVRWNVISGAVDDRTPKERGVAPLLPKYNKNGFGGIAKDVQDKVLEIPKSRYSSVDLFLGGSKFFNRTYNDTNVPINEKVLGRLLENDKAPLDYDLAKHFAHLYIRDPVSTFEELLNQDNKTSSNHFENIQSTNWQTLRFKPPTQQATPDKKDSPGWRVEFRPFEVQLLDFENAAYSVLIYLIVDSILTFSDNINAYIHMSKVWENMKIAHHRDAILFEKFHWKKSFRNDTDVETEDYSISEIFHNPENGIFPQFVTPILCQKGFVTKDWKELKHSSKHERLYYYLKLISDRASGELPTTAKFFRNFVLQHPDYKHDSKISKSINYDLLSTCDRLTHLDDSKGELTSFLGAEIAEYVKKNKPSIESKC

SEQ ID NO: 33 - protein, 491 aa, Saccharomyces cerevisiae
MAHYPPSKDQLNELIQEVNQWAITNGLSMYPPKFEENPSNASVSPVTIYPTPIPRKCFDEAVQIQPVFNELYARITQDMAQPDSYLHKTTEALALSDSEFTGKLWSLYLATLKSAQYKKQNFRLGIFRSDYLIDKKKGTEQIKQVEFNTVSVSFAGLSEKVDRLHSYLNRANKYDPKGPIYNDQNMVISDSGYLLSKALAKAVESYKSQQSSSTTSDPIVAFIVQRNERNVFDQKVLELNLLEKFGTKSVRLTFDDVNDKLFIDDKTGKLFIRDTEQEIAVVYYRTGYTTTDYTSEKDWEARLFLEKSFAIKAPDLLTQLSGSKKIQQLLTDEGVLGKYISDAEKKSSLLKTFVKIYPLDDTKLGREGKRLALSEPSKYVLKPQREGGGNNVYKENIPNFLKGIEERHWDAYILMELIEPELNENNIILRDNKSYNEPIISELGIYGCVLFNDEQVLSNEFSGSLLRSKFNTSNEGGVAAGFGCLDSIILY

SEQ ID NO: 34 - protein, 319 aa, Saccharomyces cerevisiae
MVHNKVTIIGSGPAAHTAAIYLARAEIKPILYEGMMANGIAAGGQLTTTTEIENFPGFPDGLTGSELMDRMREQSTKFGTEIITETVSKVDLSSKPFKLWTEFNEDAEPVTTDAIILATGASAKRMHLPGEETYWQKGISACAVCDGAVPIFRNKPLAVIGGGDSACEEAQFLTKYGSKVFMLVRKDHLRASTIMQKRAEKNEKIEILYNTVALEAKGDGKLLNALRIKNTKKNEETDLPVSGLFYAIGHTPATKIVAGQVDTDEAGYIKTVPGSSLTSVPGFFAAGDVQDSKYRQAITSAGSGCMAALDAEKYLTSLE

SEQ ID NO: 35 - protein, 162 aa, Saccharomyces cerevisiae
MTTSFYDLECKDKKGESFKFDQLKGKVVLIVNVASKCGFTPQYKELEELYKKYQDKGFVILGFPCNQFGKQEPGSDEQITEFCQLNYGVTFPIMKKIDVNGSNADSVYNYLKSQKAGLLGFKGIKWNFEKFLVDSNGKVVQRFSSLTKPSSLDQEIQSLLSK

SEQ ID NO: 36 - protein, 196 aa, Saccharomyces cerevisiae
MVAQVQKQAPTFKKTAVVDGVFDEVSLDKYKGKYVVLAFIPLAFTFVCPTEIIAFSEAAKKFEEQGAQVLFASTDSEYSLLAWTNIPRKEGGLGPINIPLLADTNHSLSRDYGVLIEEEGVALRGLFIIDPKGVIRHITINDLPVGRNVDEALRLVEAFQWTDKNGTVLPCNWTPGAATIKPTVEDSKEYFEAANK

SEQ ID NO: 37 - protein, 176 aa, Saccharomyces cerevisiae
MSDLVNKKFPAGDYKFQYIAISQSDADSESCKMPQTVEWSKLISENKKVIITGAPAAFSPTCTVSHIPGYINYLDELVKEKEVDQVIVVTVDNPFANQAWAKSLGVKDTTHIKFASDPGCAFTKSIGFELAVGDGVYWSGRWAMVVENGIVTYAAKETNPGTDVTVSSVESVLAHL

SEQ ID NO: 38 - protein, 483 aa, Saccharomyces cerevisiae
MLSATKQTFRSLQIRTMSTNTKHYDYLVIGGGSGGVASARRAASYGAKTLLVEAKALGGTCVNVGCVPKKVMWYASDLATRVSHANEYGLYQNLPLDKEHLTFNWPEFKQKRDAYVHRLNGIYQKNLEKEKVDVVFGWARFNKDGNVEVQKRDNTTEVYSANHILVATGGKAIFPENIPGFELGTDSDGFFRLEEQPKKVVVVGAGYIGIELAGVFHGLGSETHLVIRGETVLRKFDECIQNTITDHYVKEGINVHKLSKIVKVEKNVETDKLKIHMNDSKSIDDVDELIWTIGRKSHLGMGSENVGIKLNSHDQIIADEYQNTNVPNIYSLGDVVGKVELTPVAIAAGRKLSNRLFGPEKFRNDKLDYENVPSVIFSHPEAGSIGISEKEAIEKYGKENIKVYNSKFTAMYYAMLSEKSPTRYKIVCAGPNEKVVGLHIVGDSSAEILQGFGVAIKMGATKADFDNCVAIHPTSAEELVTMR

SEQ ID NO: 39 - protein, 570 aa, Bacillus subtilis
MTKATKEQKSLVKNRGAELVVDCLVEQGVTHVFGIPGAKIDAVFDALQDKGPEIIVARHEQNAAFMAQAVGRLTGKPGVVLVTSGPGASNLATGLLTANTEGDPVVALAGNVIRADRLKRTHQSLDNAALFQPITKYSVEVQDVKNIPEAVTNAFRIASAGQAGAAFVSFPQDVVNEVTNTKNVRAVAAPKLGPAADDAISAAIAKIQTAKLPVVLVGMKGGRPEAIKAVRKLLKKVQLPFVETYQAAGTLSRDLEDQYFGRIGLFRNQPGDLLLEQADVVLTIGYDPIEYDPKFWNINGDRTIIHLDEIIADIDHAYQPDLELIGDIPSTINHIEHDAVKVEFAEREQKILSDLKQYMHEGEQVPADWKSDRAHPLEIVKELRNAVDDHVTVTCDIGSHAIWMSRYFRSYEPLTLMISNGMQTLGVALPWAIGASLVKPGEKVVSVSGDGGFLFSAMELETAVRLKAPIVHIVWNDSTYDMVAFQQLKKYNRTSAVDFGNIDIVKYAESFGATGLRVESPDQLADVLRQGMNAEGPVIIDVPVDYSDNINLASDKLPKEFGELMKTKAL

SEQ ID NO: 40 - DNA, 1716 bp, Bacillus subtilis
atgttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctag

SEQ ID NO: 41 - protein, 559 aa, Klebsiella pneumoniae
MDKQYPVRQWAHGADLVVSQLEAQGVRQVFGIPGAKIDKVFDSLLDSSIRIIPVRHEANAAFMAAAVGRITGKAGVALVTSGPGCSNLITGMATANSEGDPVVALGGAVKRADKAKQVHQSMDTVAMFSPVTKYAIEVTAPDALAEVVSNAFRAAEQGRPGSAFVSLPQDVVDGPVSGKVLPASGAPQMGAAPDDAIDQVAKLIAQAKNPIFLLGLMASQPENSKALRRLLETSHIPVTSTYQAAGAVNQDNFSRFAGRVGLFNNQAGDRLLQLADLVICIGYSPVEYEPAMWNSGNATLVHIDVLPAYEERNYTPDVELVGDIAGTLNKLAQNIDHRLVLSPQAAEILRDRQHQRELLDRRGAQLNQFALHPLRIVRAMQDIVNSDVTLTVDMGSFHIWIARYLYTFRARQVMISNGQQTMGVALPWAIGAWLVNPERKVVSVSGDGGFLQSSMELETAVRLKANVLHLIWVDNGYNMVAIQEEKKYQRLSGVEFGPMDFKAYAESFGAKGFAVESAEALEPTLRAAMDVDGPAVVAIPVDYRDNPLLMGQLHLSQIL

SEQ ID NO: 42 - DNA, 2055 bp, Klebsiella pneumoniae
tcgaccacggggtgctgaccttcggcgaaattcacaagctgatgatcgacctgcccgccgacagcgcgttcctgcaggctaatctgcatcccgataatctcgatgccgccatccgttccgtagaaagttaagggggtcacatggacaaacagtatccggtacgccagtgggcgcacggcgccgatctcgtcgtcagtcagctggaagctcagggagtacgccaggtgttcggcatccccggcgccaaaatcgacaaggtctttgattcactgctggattcctccattcgcattattccggtacgccacgaagccaacgccgcatttatggccgccgccgtcggacgcattaccggcaaagcgggcgtggcgctggtcacctccggtccgggctgttccaacctgatcaccggcatggccaccgcgaacagcgaaggcgacccggtggtggccctgggcggcgcggtaaaacgcgccgataaagcgaagcaggtccaccagagtatggatacggtggcgatgttcagcccggtcaccaaatacgccatcgaggtgacggcgccggatgcgctggcggaagtggtctccaacgccttccgcgccgccgagcagggccggccgggcagcgcgttcgttagcctgccgcaggatgtggtcgatggcccggtcagcggcaaagtgctgccggccagcggggccccgcagatgggcgccgcgccggatgatgccatcgaccaggtggcgaagcttatcgcccaggcgaagaacccgatcttcctgctcggcctgatggccagccagccggaaaacagcaaggcgctgcgccgtttgctggagaccagccatattccagtcaccagcacctatcaggccgccggagcggtgaatcaggataacttctctcgcttcgccggccgggttgggctgtttaacaaccaggccggggaccgtctgctgcagctcgccgacctggtgatctgcatcggctacagcccggtggaatacgaaccggcgatgtggaacagcggcaacgcgacgctggtgcacatcgacgtgctgcccgcctatgaagagcgcaactacaccccggatgtcgagctggtgggcgatatcgccggcactctcaacaagctggcgcaaaatatcgatcatcggctggtgctctccccgcaggcggcggagatcctccgcgaccgccagcaccagcgcgagctgctggaccgccgcggcgcgcagctcaaccagtttgccctgcatcccctgcgcatcgttcgcgccatgcaggatatcgtcaacagcgacgtcacgttgaccgtggacatgggcagcttccatatctggattgcccgctacctgtacacgttccgcgcccgtcaggtgatgatctccaacggccagcagaccatgggcgtcgccctgccctgggctatcggcgcctggctggtcaatcctgagcgcaaagtggtctccgtctccggcgacggcggcttcctgcagtcgagcatggagctggagaccgccgtccgcctgaaagccaacgtgctgcatcttatctgggtcgataacggctacaacatggtcgctatccaggaagagaaaaaatatcagcgcctgtccggcgtcgagtttgggccgatggattttaaagcctatgccgaatccttcggcgcgaaagggtttgccgtggaaagcgccgaggcgctggagccgaccctgcgcgcggcgatggacgtcgacggcccggcggtagtggccatcccggtggattatcgcgataacccgctgctgatgggccagctgcatctgagtcagattctgtaagtcatcacaataaggaaagaaaaatgaaaaaagtcgcacttgttaccggcgccggccaggggattggtaaagctatcgcccttcgtctggtgaaggatggatttgccgtggccattgccgattataacgacgccaccgccaaagcggtcgcctccgaaatcaaccaggccggcggccgcgccatggcggtgaaagtggatgtttctgaccgcgaccaggtatttgccgccgtcga

SEQ ID NO: 43 - protein, 554 aa, Lactococcus lactis
MSEKQFGANLVVDSLINHKVKYVFGIPGAKIDRVFDLLENEEGPQMVVTRHEQGAAFMAQAVGRLTGEPGVVVVTSGPGVSNLATPLLTATSEGDAILAIGGQVKRSDRLKRAHQSMDNAGMMQSATKYSAEVLDPNTLSESIANAYRIAKSGHPGATFLSIPQDVTDAEVSIKAIQPLSDPKMGNASIDDINYLAQAIKNAVLPVILVGAGASDAKVASSLRNLLTHVNIPVVETFQGAGVISHDLEHTFYGRIGLFRNQPGDMLLKRSDLVIAVGYDPIEYEARNWNAEIDSRIIVIDNAIAEIDTYYQPERELIGDIAATLDNLLPAVRGYKIPKGTKDYLDGLHEVAEQHEFDTENTEEGRMHPLDLVSTFQEIVKDDETVTVDVGSLYIWMARHFKSYEPRHLLFSNGMQTLGVALPWAITAALLRPGKKVYSHSGDGGFLFTGQELETAVRLNLPIVQIIWNDGHYDMVKFQEEMKYGRSAAVDFGYVDYVKYAEAMRAKGYRAHSKEELAEILKSIPDTTGPVVIDVPLDYSDNIKLAEKLLPEEFY

SEQ ID NO: 44 - DNA, 3220 bp, Lactococcus lactis
tagatccggaaacaactgattacctgagttaacttagcagaaattgcagaagataacggtaatttggatgaagcattaaattacctttatcaaattccggtgaatgatgaaaattatattgctgctttaatcaaaattgctgacttatatcaatttgaagttgattttgaaacagcaatttctaagttagaagaagcaagagaattatcggattctcctctgattacttttgctttggctgagtcctactttgaacaaggtgattattcagctgccattaccgaatatgcaaaactttcagaacgaaaaattttacatgaaacaaaaatttctatttatcaaagaattggtgactcttatgcccaattaggtaattttgagaatgccatatcatttcttgaaaaatcacttgaatttgatgaaaaaccggaaaccttgtataaaattgctcttctttatggagaaactcataatgaaacaagagccattgctaatttcaaacggttagaaaaaatggatgttgaatttttgaactatgaattagcctatgcccaaaccctagaagctaatcaagaatttaaagctgcactagaaatggcaaagaaagggatgaaaaaaaatcctaatgccgttcctctcttacacttcgcttcaaaaatttgtttcaaacttaaggacaaagctgcagcagaacgttatctcgtggatgctttaaatttaccagaattacatgacgaaacagtctttttgcttgctaatttatacttcaacgaagaagattttgaagctgtcattaatcttgaagagcttttagaagatgaacatttattagctaaatggctttttgcaggagcacataaagctttggaaaatgattctgaagcggctgctttgtatgaagaactcattcaaaccaatctgtcagagaatccagagtttttagaagactatattgattttcttaaagaaattggtcaaatttctaaaacagaaccaattattgaacaatatttggaacttgttccagatgatgaaaatatgagaaatttactgacagacttaaaaaataattactgacaaagctgtcagtaattatttttattgtaagctagaaaattcaaaaacttgcgtcaaaataattgtaaaaggttctattatctgataaaatgattgtgaagtaatccaagagattatgaaatatgaattagaacaaatagaggtaaaataaaaaatgtctgagaaacaatttggggcgaacttggttgtcgatagtttgattaaccataaagtgaagtatgtatttgggattccaggagcaaaaattgaccgggtttttgatttattagaaaatgaagaaggccctcaaatggtcgtgactcgtcatgagcaaggagctgctttcatggctcaagctgtcggtcgtttaactggcgaacctggtgtagtagttgttacgagtgggcctggtgtatcaaaccttgcgactccgcttttgaccgcgacatcagaaggtgatgctattttggctatcggtggacaagttaaacgaagtgaccgtcttaaacgtgcgcaccaatcaatggataatgctggaatgatgcaatcagcaacaaaatattcagcagaagttcttgaccctaatacactttctgaatcaattgccaacgcttatcgtattgcaaaatcaggacatccaggtgcaactttcttatcaatcccccaagatgtaacggatgccgaagtatcaatcaaagccattcaaccactttcagaccctaaaatggggaatgcctctattgatgacattaattatttagcacaagcaattaaaaatgctgtattgccagtaattttggttggagctggtgcttcagatgctaaagtcgcttcatccttgcgtaatctattgactcatgttaatattcctgtcgttgaaacattccaaggtgcaggggttatttcacatgatttagaacatactttttatggacgtatcggtcttttccgcaatcaaccaggcgatatgcttctgaaacgttctgaccttgttattgctgttggttatgacccaattgaatatgaagctcgtaactggaatgcagaaattgatagtcgaattatcgttattgataatgccattgctgaaattgatacttactaccaaccagagcgtgaattaattggtgatatcgcagcaacattggataatcttttaccagctgttcgtggctacaaaattccaaaaggaacaaaagattatctcgatggccttcatgaagttgctgagcaacacgaatttgatactgaaaatactgaagaaggtagaatgcaccctcttgatttggtcagcactttccaagaaatcgtcaaggatgatgaaacagtaaccgttgacgtaggttcactctacatttggatggcacgtcatttcaaatcatacgaaccacgtcatctcctcttctcaaacggaatgcaaacactcggagttgcacttccttgggcaattacagccgcattgttgcgcccaggtaaaaaagtttattcacactctggtgatggaggcttccttttcacagggcaagaattggaaacagctgtacgtttgaatcttccaatcgttcaaattatctggaatgacggccattatgatatggttaaattccaagaagaaatgaaatatggtcgttcagcagccgttgattttggctatgttgattacgtaaaatatgctgaagcaatgagagcaaaaggttaccgtgcacacagcaaagaagaacttgctgaaattctcaaatcaatcccagatactactggaccggtggtaattgacgttcctttggactattctgataacattaaattagcagaaaaattattgcctgaagagttttattgattacaatcaagcaatttgtggcataacaaaataaaagaagaaggccttgaacacctaagcgttcagggcctttttttgtgaaataaattagatgaaatttacaatgagttttgtgaaactagcttctagtttgtgaaaaattgcctataattgccgaataaaaatacccatttaccactccaagaggatgcttcaaattagctaaatacccgttttagaggatgcgtaaaaacaacaaaagaggatgagtatagaacgataaaacttttttatgataggttgagagaattgaatataaaatataataagtagaaggcagcaatt

SEQ ID NO: 45 - protein, 491 aa, Escherichia coli
MANYFNTLNLRQQLAQLGKCRFMGRDEFADGASYLQGKKVVIVGCGAQGLNQGLNMRDSGLDISYALRKEAIAEKRASWRKATENGFKVGTYEELIPQADLVINLTPDKQHSDVVRTVQPLMKDGAALGYSHGFNIVEVGEQIRKDITVVMVAPKCPGTEVREEYKRGFGVPTLIAVHPENDPKGEGMAIAKAWAAATGGHRAGVLESSFVAEVKSDLMGEQTILCGMLQAGSLLCFDKLVEEGTDPAYAEKLIQFGWETITEALKQGGITLMMDRLSNPAKLRAYALSEQLKEIMAPLFQKHMDDIISGEFSSGMMADWANDDKKLLTWREETGKTAFETAPQYEGKIGEQEYFDKGVLMIAMVKAGVELAFETMVDSGIIEESAYYESLHELPLIANTIARKRLYEMNVVISDTAEYGNYLFSYACVPLLKPFMAELQPGDLGKAIPEGAVDNGQLRDVNEAIRSHAIEQVGKKLRGYMTDMKRIAVAG

SEQ ID NO: 46 - DNA, 1476 bp, Escherichia coli
atggctaactacttcaatacactgaatctgcgccagcagctggcacagctgggcaaatgtcgctttatgggccgcgatgaattcgccgatggcgcgagctaccttcagggtaaaaaagtagtcatcgtcggctgtggcgcacagggtctgaaccagggcctgaacatgcgtgattctggtctcgatatctcctacgctctgcgtaaagaagcgattgccgagaagcgcgcgtcctggcgtaaagcgaccgaaaatggttttaaagtgggtacttacgaagaactgatcccacaggcggatctggtgattaacctgacgccggacaagcagcactctgatgtagtgcgcaccgtacagccactgatgaaagacggcgcggcgctgggctactcgcacggtttcaacatcgtcgaagtgggcgagcagatccgtaaagatatcaccgtagtgatggttgcgccgaaatgcccaggcaccgaagtgcgtgaagagtacaaacgtgggttcggcgtaccgacgctgattgccgttcacccggaaaacgatccgaaaggcgaaggcatggcgattgccaaagcctgggcggctgcaaccggtggtcaccgtgcgggtgtgctggaatcgtccttcgttgcggaagtgaaatctgacctgatgggcgagcaaaccatcctgtgcggtatgttgcaggctggctctctgctgtgcttcgacaagctggtggaagaaggtaccgatccagcatacgcagaaaaactgattcagttcggttgggaaaccatcaccgaagcactgaaacagggcggcatcaccctgatgatggaccgtctctctaacccggcgaaactgcgtgcttatgcgctttctgaacagctgaaagagatcatggcacccctgttccagaaacatatggacgacatcatctccggcgaattctcttccggtatgatggcggactgggccaacgatgataagaaactgctgacctggcgtgaagagaccggcaaaaccgcgtttgaaaccgcgccgcagtatgaaggcaaaatcggcgagcaggagtacttcgataaaggcgtactgatgattgcgatggtgaaagcgggcgttgaactggcgttcgaaaccatggtcgattccggcatcattgaagagtctgcatattatgaatcactgcacgagctgccgctgattgccaacaccatcgcccgtaagcgtctgtacgaaatgaacgtggttatctctgataccgctgagtacggtaactatctgttctcttacgcttgtgtgccgttgctgaaaccgtttatggcagagctgcaaccgggcgacctgggtaaagctattccggaaggcgcggtagataacgggcaactgcgtgatgtgaacgaagcgattcgcagccatgcgattgagcaggtaggtaagaaactgcgcggctatatgacagatatgaaacgtattgctgttgcgggttaa

SEQ ID NO: 47 - protein, 395 aa, Saccharomyces cerevisiae
MLRTQAARLICNSRVITAKRTFALATRAAAYSRPAARFVKPMITTRGLKQINFGGTVETVYERADWPREKLLDYFKNDTFALIGYGSQGYGQGLNLRDNGLNVIIGVRKDGASWKAAIEDGWVPGKNLFTVEDAIKRGSYVMNLLSDAAQSETWPAIKPLLTKGKTLYFSHGFSPVFKDLTHVEPPKDLDVILVAPKGSGRTVRSLFKEGRGINSSYAVWNDVTGKAHEKAQALAVAIGSGYVYQTTFEREVNSDLYGERGCLMGGIHGMFLAQYDVLRENGHSPSEAFNETVEEATQSLYPLIGKYGMDYMYDACSTTARRGALDWYPIFKNALKPVFQDLYESTKNGTETKRSLEFNSQPDYREKLEKELDTIRNMEIWKVGKEVRKLRPENQ

SEQ ID NO: 48 - DNA, 1188 bp, Saccharomyces cerevisiae
atgttgagaactcaagccgccagattgatctgcaactcccgtgtcatcactgctaagagaacctttgctttggccacccgtgctgctgcttacagcagaccagctgcccgtttcgttaagccaatgatcactacccgtggtttgaagcaaatcaacttcggtggtactgttgaaaccgtctacgaaagagctgactggccaagagaaaagttgttggactacttcaagaacgacacttttgctttgatcggttacggttcccaaggttacggtcaaggtttgaacttgagagacaacggtttgaacgttatcattggtgtccgtaaagatggtgcttcttggaaggctgccatcgaagacggttgggttccaggcaagaacttgttcactgttgaagatgctatcaagagaggtagttacgttatgaacttgttgtccgatgccgctcaatcagaaacctggcctgctatcaagccattgttgaccaagggtaagactttgtacttctcccacggtttctccccagtcttcaaggacttgactcacgttgaaccaccaaaggacttagatgttatcttggttgctccaaagggttccggtagaactgtcagatctttgttcaaggaaggtcgtggtattaactcttcttacgccgtctggaacgatgtcaccggtaaggctcacgaaaaggcccaagctttggccgttgccattggttccggttacgtttaccaaaccactttcgaaagagaagtcaactctgacttgtacggtgaaagaggttgtttaatgggtggtatccacggtatgttcttggctcaatacgacgtcttgagagaaaacggtcactccccatctgaagctttcaacgaaaccgtcgaagaagctacccaatctctatacccattgatcggtaagtacggtatggattacatgtacgatgcttgttccaccaccgccagaagaggtgctttggactggtacccaatcttcaagaatgctttgaagcctgttttccaagacttgtacgaatctaccaagaacggtaccgaaaccaagagatctttggaattcaactctcaacctgactacagagaaaagctagaaaaggaattagacaccatcagaaacatggaaatctggaaggttggtaaggaagtcagaaagttgagaccagaaaaccaataa

SEQ ID NO: 49 - protein, 330 aa, Methanococcus maripaludis
MKVFYDSDFKLDALKEKTIAVIGYGSQGRAQSLNMKDSGLNVVVGLRKNGASWNNAKADGHNVMTIEEAAEKADIIHILIPDELQAEVYESQIKPYLKEGKTLSFSHGFNIHYGFIVPPKGVNVVLVAPKSPGKMVRRTYEEGFGVPGLICIEIDATNNAFDIVSAMAKGIGLSRAGVIQTTFKEETETDLFGEQAVLCGGVTELIKAGFETLVEAGYAPEMAYFETCHELKLIVDLIYQKGFKNMWNDVSNTAEYGGLTRRSRIVTADSKAAMKEILREIQDGRFTKEFLLEKQVSYAHLKSMRRLEGDLQIEEVGAKLRKMCGLEKEE

SEQ ID NO: 50 - DNA, 993 bp, Methanococcus maripaludis
atgaaggtattctatgactcagattttaaattagatgctttaaaagaaaaaacaattgcagtaatcggttatggaagtcaaggtagggcacagtccttaaacatgaaagacagcggattaaacgttgttgttggtttaagaaaaaacggtgcttcatggaacaacgctaaagcagacggtcacaatgtaatgaccattgaagaagctgctgaaaaagcggacatcatccacatcttaatacctgatgaattacaggcagaagtttatgaaagccagataaaaccatacctaaaagaaggaaaaacactaagcttttcacatggttttaacatccactatggattcattgttccaccaaaaggagttaacgtggttttagttgctccaaaatcacctggaaaaatggttagaagaacatacgaagaaggtttcggtgttccaggtttaatctgtattgaaattgatgcaacaaacaacgcatttgatattgtttcagcaatggcaaaaggaatcggtttatcaagagctggagttatccagacaactttcaaagaagaaacagaaactgaccttttcggtgaacaagctgttttatgcggtggagttaccgaattaatcaaggcaggatttgaaacactcgttgaagcaggatacgcaccagaaatggcatactttgaaacctgccacgaattgaaattaatcgttgacttaatctaccaaaaaggattcaaaaacatgtggaacgatgtaagtaacactgcagaatacggcggacttacaagaagaagcagaatcgttacagctgattcaaaagctgcaatgaaagaaatcttaagagaaatccaagatggaagattcacaaaagaattccttctcgaaaaacaggtaagctatgctcatttaaaatcaatgagaagactcgaaggagacttacaaatcgaagaagtcggcgcaaaattaagaaaaatgtgcggtcttgaaaaagaagaataa

SEQ ID NO: 51 - protein, 342 aa, Bacillus subtilis
MVKVYYNGDIKENVLAGKTVAVIGYGSQGHAHALNLKESGVDVIVGVRQGKSFTQAQEDGHKVFSVKEAAAQAEIIMVLLPDEQQQKVYEAEIKDELTAGKSLVFAHGFNVHFHQIVPPADVDVFLVAPKGPGHLVRRTYEQGAGVPALFAIYQDVTGEARDKALAYAKGIGGARAGVLETTFKEETETDLFGEQAVLCGGLSALVKAGFETLTEAGYQPELAYFECLHELKLIVDLMYEEGLAGMRYSISDTAQWGDFVSGPRVVDAKVKESMKEVLKDIQNGTFAKEWIVENQVNRPRFNAINASENEHQIEVVGRKLREMMPFVKQGKKKEAVVSVAQN

SEQ ID NO: 52 - DNA, 1476 bp, Bacillus subtilis; identical to SEQ ID NO: 46

SEQ ID NO: 53 - protein, 343 aa, Anaerostipes caccae
MEECKMAKIYYQEDCNLSLLDGKTIAVIGYGSQGHAHALNAKESGCNVIIGLYEGAKEWKRAEEQGFEVYTAAEAAKKADIIMILINDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 54 - protein, 343 aa, Anaerostipes caccae
MEECKMAKIYYQEDCNLSLLDGKTIAVIGYGSQGHAHALNAKESGCNVIIGLYEGAKDWKRAEEQGFEVYTAAEAAKKADIIMILINDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 55 - protein, 616 aa, Escherichia coli
MPKYRSATTTHGRNMAGARALWRATGMTDADFGKPIIAVVNSFTQFVPGHVHLRDLGKLVAEQIEAAGGVAKEFNTIAVDDGIAMGHGGMLYSLPSRELIADSVEYMVNAHCADAMVCISNCDKITPGMLMASLRLNIPVIFVSGGPMEAGKTKLSDQIIKLDLVDAMIQGADPKVSDSQSDQVERSACPTCGSCSGMFTANSMNCLTEALGLSQPGNGSLLATHADRKQLFLNAGKRIVELTKRYYEQNDESALPRNIASKAAFENAMTLDIAMGGSTNTVLHLLAAAQEAEIDFTMSDIDKLSRKVPQLCKVAPSTQKYHMEDVHRAGGVIGILGELDRAGLLNRDVKNVLGLTLPQTLEQYDVMLTQDDAVKNMFRAGPAGIRTTQAFSQDCRWDTLDDDRANGCIRSLEHAYSKDGGLAVLYGNFAENGCIVKTAGVDDSILKFTGPAKVYESQDDAVEAILGGKVVAGDVVVIRYEGPKGGPGMQEMLYPTSFLKSMGLGKACALITDGRFSGGTSGLSIGHVSPEAASGGSIGLIEDGDLIAIDIPNRGIQLQVSDAELAARREAQDARGDKAWTPKNRERQVSFALRAYASLATSADKGAVRDKSKLGG

SEQ ID NO: 56 - DNA, 1851 bp, Escherichia coli
atgcctaagtaccgttccgccaccaccactcatggtcgtaatatggcgggtgctcgtgcgctgtggcgcgccaccggaatgaccgacgccgatttcggtaagccgattatcgcggttgtgaactcgttcacccaatttgtaccgggtcacgtccatctgcgcgatctcggtaaactggtcgccgaacaaattgaagcggctggcggcgttgccaaagagttcaacaccattgcggtggatgatgggattgccatgggccacggggggatgctttattcactgccatctcgcgaactgatcgctgattccgttgagtatatggtcaacgcccactgcgccgacgccatggtctgcatctctaactgcgacaaaatcaccccggggatgctgatggcttccctgcgcctgaatattccggtgatctttgtttccggcggcccgatggaggccgggaaaaccaaactttccgatcagatcatcaagctcgatctggttgatgcgatgatccagggcgcagacccgaaagtatctgactcccagagcgatcaggttgaacgttccgcgtgtccgacctgcggttcctgctccgggatgtttaccgctaactcaatgaactgcctgaccgaagcgctgggcctgtcgcagccgggcaacggctcgctgctggcaacccacgccgaccgtaagcagctgttccttaatgctggtaaacgcattgttgaattgaccaaacgttattacgagcaaaacgacgaaagtgcactgccgcgtaatatcgccagtaaggcggcgtttgaaaacgccatgacgctggatatcgcgatgggtggatcgactaacaccgtacttcacctgctggcggcggcgcaggaagcggaaatcgacttcaccatgagtgatatcgataagctttcccgcaaggttccacagctgtgtaaagttgcgccgagcacccagaaataccatatggaagatgttcaccgtgctggtggtgttatcggtattctcggcgaactggatcgcgcggggttactgaaccgtgatgtgaaaaacgtacttggcctgacgttgccgcaaacgctggaacaatacgacgttatgctgacccaggatgacgcggtaaaaaatatgttccgcgcaggtcctgcaggcattcgtaccacacaggcattctcgcaagattgccgttgggatacgctggacgacgatcgcgccaatggctgtatccgctcgctggaacacgcctacagcaaagacggcggcctggcggtgctctacggtaactttgcggaaaacggctgcatcgtgaaaacggcaggcgtcgatgacagcatcctcaaattcaccggcccggcgaaagtgtacgaaagccaggacgatgcggtagaagcgattctcggcggtaaagttgtcgccggagatgtggtagtaattcgctatgaaggcccgaaaggcggtccggggatgcaggaaatgctctacccaaccagcttcctgaaatcaatgggtctcggcaaagcctgtgcgctgatcaccgacggtcgtttctctggtggcacctctggtctttccatcggccacgtctcaccggaagcggcaagcggcggcagcattggcctgattgaagatggtgacctgatcgctatcgacatcccgaaccgtggcattcagttacaggtaagcgatgccgaactggcggcgcgtcgtgaagcgcaggacgctcgaggtgacaaagcctggacgccgaaaaatcgtgaacgtcaggtctcctttgccctgcgtgcttatgccagcctggcaaccagcgccgacaaaggcgcggtgcgcgataaatcgaaactggggggttaa

SEQ ID NO: 57 - protein, 585 aa, Saccharomyces cerevisiae
MGLLTKVATSRQFSTTRCVAKKLNKYSYIITEPKGQGASQAMLYATGFKKEDFKKPQVGVGSCWWSGNPCNMHLLDLNNRCSQSIEKAGLKAMQFNTIGVSDGISMGTKGMRYSLQSREIIADSFETIMMAQHYDANIAIPSCDKNMPGVMMAMGRHNRPSIMVYGGTILPGHPTCGSSKISKNIDIVSAFQSYGEYISKQFTEEEREDVVEHACPGPGSCGGMYTANTMASAAEVLGLTIPNSSSFPAVSKEKLAECDNIGEYIKKTMELGILPRDILTKEAFENAITYVVATGGSTNAVLHLVAVAHSAGVKLSPDDFQRISDTTPLIGDFKPSGKYVMADLINVGGTQSVIKYLYENNMLHGNTMTVTGDTLAERAKKAPSLPEGQEIIKPLSHPIKANGHLQILYGSLAPGGAVGKITGKEGTYFKGRARVFEEEGAFIEALERGEIKKGEKTVVVIRYEGPRGAPGMPEMLKPSSALMGYGLGKDVALLTDGRFSGGSHGFLIGHIVPEAAEGGPIGLVRDGDEIIIDADNNKIDLLVSDKEMAQRKQSWVAPPPRYTRGTLSKYAKLVSNASNGCVLDA

SEQ ID NO: 58 - DNA, 1131 bp, Saccharomyces cerevisiae
atgaccttggcacccctagacgcctccaaagttaagataactaccacacaacatgcatctaagccaaaaccgaacagtgagttagtgtttggcaagagcttcacggaccacatgttaactgcggaatggacagctgaaaaagggtggggtaccccagagattaaaccttatcaaaatctgtctttagacccttccgcggtggttttccattatgcttttgagctattcgaagggatgaaggcttacagaacggtggacaacaaaattacaatgtttcgtccagatatgaatatgaagcgcatgaataagtctgctcagagaatctgtttgccaacgttcgacccagaagagttgattaccctaattgggaaactgatccagcaagataagtgcttagttcctgaaggaaaaggttactctttatatatcaggcctacattaatcggcactacggccggtttaggggtttccacgcctgatagagccttgctatatgtcatttgctgccctgtgggtccttattacaaaactggatttaaggcggtcagactggaagccactgattatgccacaagagcttggccaggaggctgtggtgacaagaaactaggtgcaaactacgccccctgcgtcctgccacaattgcaagctgcttcaaggggttaccaacaaaatttatggctatttggtccaaataacaacattactgaagtcggcaccatgaatgcttttttcgtgtttaaagatagtaaaacgggcaagaaggaactagttactgctccactagacggtaccattttggaaggtgttactagggattccattttaaatcttgctaaagaaagactcgaaccaagtgaatggaccattagtgaacgctacttcactataggcgaagttactgagagatccaagaacggtgaactacttgaagcctttggttctggtactgctgcgattgtttctcccattaaggaaatcggctggaaaggcgaacaaattaatattccgttgttgcccggcgaacaaaccggtccattggccaaagaagttgcacaatggattaatggaatccaatatggcgagactgagcatggcaattggtcaagggttgttactgatttgaactga

SEQ ID NO: 59 - protein, 550 aa, Methanococcus maripaludis
MISDNVKKGVIRTPNRALLKACGYTDEDMEKPFIGIVNSFTEVVPGHIHLRTLSEAAKHGVYANGGTPFEFNTIGICDGIAMGHEGMKYSLPSREIIADAVESMARAHGFDGLVLIPTCDKIVPGMIMGALRLNIPFIVVTGGPMLPGEFQGKKYELISLFEGVGEYQVGKITEEELKCIEDCACSGAGSCAGLYTANSMACLTEALGLSLPMCATTHAVDAQKVRLAKKSGSKIVDMVKEDLKPTDILTKEAFENAILVDLALGGSTNTTLHIPAIANEIENKFITLDDFDRLSDEVPHIASIKPGGEHYMIDLHNAGGIPAVLNVLKEKIRDTKTVDGRSILEIAESVKYINYDVIRKVEAPVHETAGLRVLKGNLAPNGCVVKIGAVHPKMYKHDGPAKVYNSEDEAISAILGGKIVEGDVIVIRYEGPSGGPGMREMLSPTSAICGMGLDDSVALITDGRFSGGSRGPCIGHVSPEAAAGGVIAAIENGDIIKIDMIEKEINVDLDESVIKERLSKLGEFEPKIKKGYLSRYSKLVSSADEGAVLK

SEQ ID NO: 60 - DNA, 1653 bp, Methanococcus maripaludis
atgataagtgataacgtcaaaaagggagttataagaactccaaaccgagctcttttaaaggcttgcggatatacagacgaagacatggaaaaaccatttattggaattgtaaacagctttacagaagttgttcccggccacattcacttaagaacattatcagaagcggctaaacatggtgtttatgcaaacggtggaacaccatttgaatttaataccattggaatttgcgacggtattgcaatgggccacgaaggtatgaaatactctttaccttcaagagaaattattgcagacgctgttgaatcaatggcaagagcacatggatttgatggtcttgttttaattcctacgtgtgataaaatcgttcctggaatgataatgggtgctttaagactaaacattccatttattgtagttactggaggaccaatgcttcccggagaattccaaggtaaaaaatacgaacttatcagcctttttgaaggtgtcggagaataccaagttggaaaaattactgaagaagagttaaagtgcattgaagactgtgcatgttcaggtgctggaagttgtgcagggctttacactgcaaacagtatggcctgccttacagaagctttgggactctctcttccaatgtgtgcaacaacgcatgcagttgatgcccaaaaagttaggcttgctaaaaaaagtggctcaaaaattgttgatatggtaaaagaagacctaaaaccaacagacatattaacaaaagaagcttttgaaaatgctattttagttgaccttgcacttggtggatcaacaaacacaacattacacattcctgcaattgcaaatgaaattgaaaataaattcataactctcgatgactttgacaggttaagcgatgaagttccacacattgcatcaatcaaaccaggtggagaacactacatgattgatttacacaatgctggaggtattcctgcggtattgaacgttttaaaagaaaaaattagagatacaaaaacagttgatggaagaagcattttggaaatcgcagaatctgttaaatacataaattacgacgttataagaaaagtggaagctccggttcacgaaactgctggtttaagggttttaaagggaaatcttgctccaaacggttgcgttgtaaaaatcggtgcagtacatccgaaaatgtacaaacacgatggacctgcaaaagtttacaattccgaagatgaagcaatttctgcgatacttggcggaaaaattgtagaaggggacgttatagtaatcagatacgaaggaccatcaggaggccctggaatgagagaaatgctctccccaacttcagcaatctgtggaatgggtcttgatgacagcgttgcattgattactgatggaagattcagtggtggaagtaggggcccatgtatcggacacgtttctccagaagctgcagctggcggagtaattgctgcaattgaaaacggggatatcatcaaaatcgacatgattgaaaaagaaataaatgttgatttagatgaatcagtcattaaagaaagactctcaaaactgggagaatttgagcctaaaatcaaaaaaggctatttatcaagatactcaaaacttgtctcatctgctgacgaaggggcagttttaaaataa

SEQ ID NO: 61 - protein, 558 aa, Bacillus subtilis
MAELRSNMITQGIDRAPHRSLLRAAGVKEEDFGKPFIAVCNSYIDIVPGHVHLQEFGKIVKEAIREAGGVPFEFNTIGVDDGIAMGHIGMRYSLPSREIIADSVETVVSAHWFDGMVCIPNCDKITPGMLMAAMRINIPTIFVSGGPMAAGRTSDGRKISLSSVFEGVGAYQAGKINENELQELEQFGCPTCGSCSGMFTANSMNCLSEALGLALPGNGTILATSPERKEFVRKSAAQLMETIRKDIKPRDIVTVKAIDNAFALDMALGGSTNTVLHTLALANEAGVEYSLERINEVAERVPHLAKLAPASDVFIEDLHEAGGVSAALNELSKKEGALHLDALTVTGKTLGETIAGHEVKDYDVIHPLDQPFTEKGGLAVLFGNLAPDGAIIKTGGVQNGITRHEGPAVVFDSQDEALDGIINRKVKEGDVVIIRYEGPKGGPGMPEMLAPTSQIVGMGLGPKVALITDGRFSGASRGLSIGHVSPEAAEGGPLAFVENGDHIIVDIEKRILDVQVPEEEWEKRKANWKGFEPKVKTGYLARYSKLVTSANTGGIMKI

SEQ ID NO: 62 - DNA, 1677 bp, Bacillus subtilis
atggcagaattacgcagtaatatgatcacacaaggaatcgatagagctccgcaccgcagtttgcttcgtgcagcaggggtaaaagaagaggatttcggcaagccgtttattgcggtgtgtaattcatacattgatatcgttcccggtcatgttcacttgcaggagtttgggaaaatcgtaaaagaagcaatcagagaagcagggggcgttccgtttgaatttaataccattggggtagatgatggcatcgcaatggggcatatcggtatgagatattcgctgccaagccgtgaaattatcgcagactctgtggaaacggttgtatccgcacactggtttgacggaatggtctgtattccgaactgcgacaaaatcacaccgggaatgcttatggcggcaatgcgcatcaacattccgacgatttttgtcagcggcggaccgatggcggcaggaagaacaagttacgggcgaaaaatctccctttcctcagtattcgaaggggtaggcgcctaccaagcagggaaaatcaacgaaaacgagcttcaagaactagagcagttcggatgcccaacgtgcgggtcttgctcaggcatgtttacggcgaactcaatgaactgtctgtcagaagcacttggtcttgctttgccgggtaatggaaccattctggcaacatctccggaacgcaaagagtttgtgagaaaatcggctgcgcaattaatggaaacgattcgcaaagatatcaaaccgcgtgatattgttacagtaaaagcgattgataacgcgtttgcactcgatatggcgctcggaggttctacaaataccgttcttcatacccttgcccttgcaaacgaagccggcgttgaatactctttagaacgcattaacgaagtcgctgagcgcgtgccgcacttggctaagctggcgcctgcatcggatgtgtttattgaagatcttcacgaagcgggcggcgtttcagcggctctgaatgagctttcgaagaaagaaggagcgcttcatttagatgcgctgactgttacaggaaaaactcttggagaaaccattgccggacatgaagtaaaggattatgacgtcattcacccgctggatcaaccattcactgaaaagggaggccttgctgttttattcggtaatctagctccggacggcgctatcattaaaacaggcggcgtacagaatgggattacaagacacgaagggccggctgtcgtattcgattctcaggacgaggcgcttgacggcattatcaaccgaaaagtaaaagaaggcgacgttgtcatcatcagatacgaagggccaaaaggcggacctggcatgccggaaatgctggcgccaacatcccaaatcgttggaatgggactcgggccaaaagtggcattgattacggacggacgtttttccggagcctcccgtggcctctcaatcggccacgtatcacctgaggccgctgagggcgggccgcttgcctttgttgaaaacggagaccatattatcgttgatattgaaaaacgcatcttggatgtacaagtgccagaagaagagtgggaaaaacgaaaagcgaactggaaaggttttgaaccgaaagtgaaaaccggctacctggcacgttattctaaacttgtgacaagtgccaacaccggcggtattatgaaaatctag

SEQ ID NO: 63 - protein, 547 aa, Lactococcus lactis
MYTVGDYLLDRLHELGIEEIFGVPGDYNLQFLDQIISREDMKWIGNANELNASYMADGYARTKKAAAFLTTFGVGELSAINGLAGSYAENLPVVEIVGSPTSKVQNDGKFVHHTLADGDFKHFMKMHEPVTAARTLLTAENATYEIDRVLSQLLKERKPVYINLPVDVAAAKAEKPALSLEKESSTTNTTEQVILSKIEESLKNAQKPVVIAGHEVISFGLEKTVTQFVSETKLPITTLNFGKSAVDESLPSFLGIYNGKLSEISLKNFVESADFILMLGVKLTDSSTGAFTHHLDENKMISLNIDEGIIFNKVVEDFDFRAVVSSLSELKGIEYEGQYIDKQYEEFIPSSAPLSQDRLWQAVESLTQSNETIVAEQGTSFFGASTIFLKSNSRFIGQPLWGSIGYTFPAALGSQIADKESRHLLFIGDGSLQLTVQELGLSIREKLNPICFIINNDGYTVEREIHGPTQSYNDIPMWNYSKLPETFGATEDRVVSKIVRTENEFVSVMKEAQADVNRMYWIELVLEKEDAPKLLKKMGKLFAEQNK

SEQ ID NO: 64 - DNA, 1828 bp, Lactococcus lactis
tttaaataagtcaatatcgttgacttatttagaagaaagagttattctttaaatgtcaagttagttgactaaattaaatataaaatatggaggaatgtgatgtatacagtaggagattacctgttagaccgattacacgagttgggaattgaagaaatttttggagttcctggtgactataacttacaatttttagatcaaattatttcacgcgaagatatgaaatggattggaaatgctaatgaattaaatgcttcttatatggctgatggttatgctcgtactaaaaaagctgccgcatttctcaccacatttggagtcggcgaattgagtgcgatcaatggactggcaggaagttatgccgaaaatttaccagtagtagaaattgttggttcaccaacttcaaaagtacaaaatgacggaaaatttgtccatcatacactagcagatggtgattttaaacactttatgaagatgcatgaacctgttacagcagcgcggactttactgacagcagaaaatgccacatatgaaattgaccgagtactttctcaattactaaaagaaagaaaaccagtctatattaacttaccagtcgatgttgctgcagcaaaagcagagaagcctgcattatctttagaaaaagaaagctctacaacaaatacaactgaacaagtgattttgagtaagattgaagaaagtttgaaaaatgcccaaaaaccagtagtgattgcaggacacgaagtaattagttttggtttagaaaaaacggtaactcagtttgtttcagaaacaaaactaccgattacgacactaaattttggtaaaagtgctgttgatgaatctttgccctcatttttaggaatatataacgggaaactttcagaaatcagtcttaaaaattttgtggagtccgcagactttatcctaatgcttggagtgaagcttacggactcctcaacaggtgcattcacacatcatttagatgaaaataaaatgatttcactaaacatagatgaaggaataattttcaataaagtggtagaagattttgattttagagcagtggtttcttctttatcagaattaaaaggaatagaatatgaaggacaatatattgataagcaatatgaagaatttattccatcaagtgctcccttatcacaagaccgtctatggcaggcagttgaaagtttgactcaaagcaatgaaacaatcgttgctgaacaaggaacctcattttttggagcttcaacaattttcttaaaatcaaatagtcgttttattggacaacctttatggggttctattggatatacttttccagcggctttaggaagccaaattgcggataaagagagcagacaccttttatttattggtgatggttcacttcaacttaccgtacaagaattaggactatcaatcagagaaaaactcaatccaatttgttttatcataaataatgatggttatacagttgaaagagaaatccacggacctactcaaagttataacgacattccaatgtggaattactcgaaattaccagaaacatttggagcaacagaagatcgtgtagtatcaaaaattgttagaacagagaatgaatttgtgtctgtcatgaaagaagcccaagcagatgtcaatagaatgtattggatagaactagttttggaaaaagaagatgcgccaaaattactgaaaaaaatgggtaaattatttgctgagcaaaataaatagatatcaacggatgatgaaaagtaaaatagacaaagtccaataattttataaaaagtaaaaacattaggattttcctaatgttttt

SEQ ID NO: 65 - protein, 548 aa, Lactococcus lactis
MYTVGDYLLDRLHELGIEEIFGVPGDYNLQFLDQIISHKDMKWVGNANELNASYMADGYARTKKAAAFLTTFGVGELSAVNGLAGSYAENLPVVEIVGSPTSKVQNEGKFVHHTLADGDFKHFMKMHEPVTAARTLLTAENATVEIDRVLSALLKERKPVYINLPVDVAAAKAEKPSLPLKKENSTSNTSDQEILNKIQESLKNAKKPIVITGHEIISFGLEKTVTQFISKTKLPITTLNFGKSSVDEALPSFLGIYNGTLSEPNLKEFVESADFILMLGVKLTDSSTGAFTHHLNENKMISLNIDEGKIFNERIQNFDFESLISSLLDLSEIEYKGKYIDKKQEDFVPSNALLSQDRLWQAVENLTQSNETIVAEQGTSFFGASSIFLKSKSHFIGQPLWGSIGYTFPAALGSQIADKESRHLLFIGDGSLQLTVQELGLAIREKINPICFIINNDGYTVEREIHGPNQSYNDIPMWNYSKLPESFGATEDRVVSKIVRTENEFVSVMKEAQADPNRMYWIELILAKEGAPKVLKKMGKLFAEQNKS

SEQ ID NO: 66 - DNA, 1954 bp, Lactococcus lactis
ctagagttttctttagtcataattcactccttttattagtctattatacttgataattcaaataagtcaatatcgttgacttatttaaagaaaagcgttattctataaatgtcaagttgattgaccaatatataataaaatatggaggaatgcgatgtatacagtaggagattacctattagaccgattacacgagttaggaattgaagaaatttttggagtccctggagactataacttacaatttttagatcaaattatttcccacaaggatatgaaatgggtcggaaatgctaatgaattaaatgcttcatatatggctgatggctatgctcgtactaaaaaagctgccgcatttcttacaacctttggagtaggtgaattgagtgcagttaatggattagcaggaagttacgccgaaaatttaccagtagtagaaatagtgggatcacctacatcaaaagttcaaaatgaaggaaaatttgttcatcatacgctggctgacggtgattttaaacactttatgaaaatgcacgaacctgttacagcagctcgaactttactgacagcagaaaatgcaaccgttgaaattgaccgagtactttctgcactattaaaagaaagaaaacctgtctatatcaacttaccagttgatgttgctgctgcaaaagcagagaaaccctcactccctttgaaaaaggaaaactcaacttcaaatacaagtgaccaagaaattttgaacaaaattcaagaaagcttgaaaaatgccaaaaaaccaatcgtgattacaggacatgaaataattagttttggcttagaaaaaacagtcactcaatttatttcaaagacaaaactacctattacgacattaaactttggtaaaagttcagttgatgaagccctcccttcatttttaggaatctataatggtacactctcagagcctaatcttaaagaattcgtggaatcagccgacttcatcttgatgcttggagttaaactcacagactcttcaacaggagccttcactcatcatttaaatgaaaataaaatgatttcactgaatatagatgaaggaaaaatatttaacgaaagaatccaaaattttgattttgaatccctcatctcctctctcttagacctaagcgaaatagaatacaaaggaaaatatatcgataaaaagcaagaagactttgttccatcaaatgcgcttttatcacaagaccgcctatggcaagcagttgaaaacctaactcaaagcaatgaaacaatcgttgctgaacaagggacatcattctttggcgcttcatcaattttcttaaaatcaaagagtcattttattggtcaacccttatggggatcaattggatatacattcccagcagcattaggaagccaaattgcagataaagaaagcagacaccttttatttattggtgatggttcacttcaacttacagtgcaagaattaggattagcaatcagagaaaaaattaatccaatttgctttattatcaataatgatggttatacagtcgaaagagaaattcatggaccaaatcaaagctacaatgatattccaatgtggaattactcaaaattaccagaatcgtttggagcaacagaagatcgagtagtctcaaaaatcgttagaactgaaaatgaatttgtgtctgtcatgaaagaagctcaagcagatccaaatagaatgtactggattgagttaattttggcaaaagaaggtgcaccaaaagtactgaaaaaaatgggcaaactatttgctgaacaaaataaatcataatttataaatagtaaaaaacattaggaaatacctaatgtttttttgttgactaaatcaatccctctttatatagaaaaccttagtttctcaaagacaacttaattaagcctgccaaattggaactcgcaaaatgtaatctatcctctgctccta

SEQ ID NO: 67 - protein, 550 aa, Salmonella typhimurium
MQNPYTVADYLLDRLAGCGIGHLFGVPGDYNLQFLDHVIDHPTLRWVGCANELNAAYAADGYARMSGAGALLTTFGVGELSAINGIAGSYAEYVPVLHIVGAPCSAAQQRGELMHHTLGDGDFRHFYRMSQAISAASAILDEQNACFEIDRVLGEMLAARRPGYIMLPADVAKKTAIPPTQALALPVHEAQSGVETAFRYHARQCLMNSRRIALLADFLAGRFGLRPLLQRWMAETPIAHATLLMGKGLFDEQHPNFVGTYSAGASSKEVRQAIEDADRVICVGTRFVDTLTAGFTQQLPAERTLEIQPYASRIGETWFNLPMAQAVSTLRELCLECAFAPPPTRSAGQPVRIDKGELTQESFWQTLQQYLKPGDIILVDQGTAAFGAAALSLPDGAEVVLQPLWGSIGYSLPAAFGAQTACPDRRVILIIGDGAAQLTIQEMGSMLRDGQAPVILLLNNDGYTVERAIHGAAQRYNDIASWNWTQIPPALNAAQQAECWRVTQAIQLAEVLERLARPQRLSFIEVMLPKADLPELLRTVTRALEARNGG

SEQ ID NO: 68 - DNA, 1653 bp, Salmonella typhimurium
ttatcccccgttgcgggcttccagcgcccgggtcacggtacgcagtaattccggcagatcggcttttggcaacatcacttcaataaatgacagacgttgtgggcgcgccaaccgttcgaggacctctgccagttggatagcctgcgtcacccgccagcactccgcctgttgcgccgcgtttagcgccggtggtatctgcgtccagttccagctcgcgatgtcgttataccgctgggccgcgccgtgaatggcgcgctctacggtatagccgtcattgttgagcagcaggatgaccggcgcctgcccgtcgcgtaacatcgagcccatctcctgaatcgtgagctgcgccgcgccatcgccgataatcagaatcacccgccgatcgggacaggcggtttgcgcgccaaacgcggcgggcaaggaatagccgatagacccccacagcggctgtaacacaacttccgcgccgtcaggaagcgacagcgcggcagcgccaaaagctgctgtcccctggtcgacaaggataatatctccgggtttgagatactgctgtaaggtttgccagaagctttcctgggtcagttctcctttatcaatccgcactggctgtccggcggaacgcgtcggcggcggcgcaaaagcgcattccaggcacagttcgcgcagcgtagacaccgcctgcgccatcgggaggttgaaccaggtttcgccgatgcgcgacgcgtaaggctgaatctccagcgtgcgttccgccggtaattgttgggtaaatccggccgtaagggtatcgacaaaacgggtgccgacgcagataaccctatcggcgtcctctatggcctgacgcacttctttgctgctggcgccagcgctataggtgccaacgaagttcgggtgctgttcatcaaaaagccccttccccatcagtagtgtcgcatgagcgatgggcgtttccgccatccagcgctgcaacagtggtcgtaaaccaaaacgcccggcaagaaagtcggccaatagcgcaatgcgccgactgttcatcaggcactgacgggcgtgataacgaaaggccgtctccacgccgctttgcgcttcatgcacgggcaacgccagcgcctgcgtaggtgggatggccgtttttttcgccacatcggcgggcaacatgatgtatcctggcctgcgtgcggcaagcatttcacccaacacgcggtcaatctcgaaacaggcgttctgttcatctaatattgcgctggcagcggatatcgcctgactcatgcgataaaaatgacgaaaatcgccgtcaccgagggtatggtgcatcaattcgccacgctgctgcgcagcgctacagggcgcgccgacgatatgcaagaccgggacatattccgcgtaactgcccgcgataccgttaatagcgctaagttctcccacgccaaaggtggtgagtagcgctccagcgcccgacatgcgcgcatagccgtccgcggcataagcggcgttcagctcattggcgcatcccacccaacgcagggtcgggtggtcaatcacatggtcaagaaactgcaagttataatcgcccggtacgccaaaaagatggccaatgccgcatcctgccagtctgtccagcaaatagtcggccacggtataggggttttgcat

SEQ ID NO: 69 - protein, 554 aa, Clostridium acetobutylicum
MKSEYTIGRYLLDRLSELGIRHIFGVPGDYNLSFLDYIMEYKGIDWVGNCNELNAGYAADGYARINGIGAILTTFGVGELSAINAIAGAYAEQVPVVKITGIPTAKVRDNGLYVHHTLGDGRFDHFFEMFREVTVAEALLSEENAAQEIDRVLISCWRQKRPVLINLPIDVYDKPINKPLKPLLDYTISSNKEAACEFVTEIVPIINRAKKPVILADYGVYRYQVQHVLKNLAEKTGFPVATLSMGKGVFNEAHPQFIGVYNGDVSSPYLRQRVDEADCIISVGVKLTDSTTGGFSHGFSKRNVIHIDPFSIKAKGKKYAPITMKDALTELTSKIEHRNFEDLDIKPYKSDNQKYFAKEKPITQKRFFERIAHFIKEKDVLLAEQGTCFFGASTIQLPKDATFIGQPLWGSIGYTLPALLGSQLADQKRRNILLIGDGAFQMTAQEISTMLRLQIKPIIFLINNDGYTIERAIHGREQVYNNIQMWRYHNVPKVLGPKECSLTFKVQSETELEKALLVADKDCEHLIFIEVVMDRYDKPEPLERLSKRFANQNN

SEQ ID NO: 70 - DNA, 1665 bp, Clostridium acetobutylicum
ttgaagagtgaatacacaattggaagatatttgttagaccgtttatcagagttgggtattcggcatatctttggtgtacctggagattacaatctatcctttttagactatataatggagtacaaagggatagattgggttggaaattgcaatgaattgaatgctgggtatgctgctgatggatatgcaagaataaatggaattggagccatacttacaacatttggtgttggagaattaagtgccattaacgcaattgctggggcatacgctgagcaagttccagttgttaaaattacaggtatccccacagcaaaagttagggacaatggattatatgtacaccacacattaggtgacggaaggtttgatcacttttttgaaatgtttagagaagtaacagttgctgaggcattactaagcgaagaaaatgcagcacaagaaattgatcgtgttcttatttcatgctggagacaaaaacgtcctgttcttataaatttaccgattgatgtatatgataaaccaattaacaaaccattaaagccattactcgattatactatttcaagtaacaaagaggctgcatgtgaatttgttacagaaatagtacctataataaatagggcaaaaaagcctgttattcttgcagattatggagtatatcgttaccaagttcaacatgtgcttaaaaacttggccgaaaaaaccggatttcctgtggctacactaagtatgggaaaaggtgttttcaatgaagcacaccctcaatttattggtgtttataatggtgatgtaagttctccttatttaaggcagcgagttgatgaagcagactgcattattagcgttggtgtaaaattgacggattcaaccacagggggattttctcatggattttctaaaaggaatgtaattcacattgatcctttttcaataaaggcaaaaggtaaaaaatatgcacctattacgatgaaagatgctttaacagaattaacaagtaaaattgagcatagaaactttgaggatttagatataaagccttacaaatcagataatcaaaagtattttgcaaaagagaagccaattacacaaaaacgtttttttgagcgtattgctcactttataaaagaaaaagatgtattattagcagaacagggtacatgcttttttggtgcgtcaaccatacaactacccaaagatgcaacttttattggtcaacctttatggggatctattggatacacacttcctgctttattaggttcacaattagctgatcaaaaaaggcgtaatattcttttaattggggatggtgcatttcaaatgacagcacaagaaatttcaacaatgcttcgtttacaaatcaaacctattatttttttaattaataacgatggttatacaattgaacgtgctattcatggtagagaacaagtatataacaatattcaaatgtggcgatatcataatgttccaaaggttttaggtcctaaagaatgcagcttaacctttaaagtacaaagtgaaactgaacttgaaaaggctcttttagtggcagataaggattgtgaacatttgatttttatagaagttgttatggatcgttatgataaacccgagcctttagaacgtctttcgaaacgttttgcaaatcaaaataattag

SEQ ID NO: 71 - DNA, 1641 bp, Clostridium acetobutylicum
atgaaacaacgtatcgggcaatacttgatcgatgccctacacgttaatggtgtcgataagatctttggagtcccaggtgatttcactttagcctttttggacgatatcataagacatgacaacgtggaatgggtgggaaatactaatgagttgaacgccgcttacgccgctgatggttacgctagagttaatggattagccgctgtatctaccacttttggggttggcgagttatctgctgtgaatggtattgctggaagttacgcagagcgtgttcctgtaatcaaaatctcaggcggtccttcatcagttgctcaacaagagggtagatatgtccaccattcattgggtgaaggaatctttgattcatattcaaagatgtacgctcacataaccgcaacaactacaatcttatccgttgacaacgcagtcgacgaaattgatagagttattcattgtgctttgaaggaaaagaggccagtgcatattcatttgcctattgacgtagccttaactgagattgaaatccctcatgcaccaaaagtttacacacacgaatcccagaacgtcgatgcttacattcaagctgttgagaaaaagttaatgtctgcaaaacaaccagtaatcatagcaggtcatgaaatcaattcattcaagttgcacgaacaactggaacagtttgtcaatcagacaaacatccctgttgcacaactttccttgggtaagtctgctttcaatgaagagaatgaacattaccttggtatctacgatggcaaaatcgcaaaggaaaatgtgagagagtacgtcgacaatgctgatgtcatattgaacataggtgccaaactgactgattctgctacagctggattttcctacaagttcgatacaaacaacataatctacattaaccataatgacttcaaagctgaagatgtgatttctgataatgtttcactgattgatcttgtgaatggcctgaattctattgactatagaaatgaaacacactacccatcttatcaaagatctgatatgaaatacgaattgaatgacgcaccacttacacaatctaactatttcaaaatgatgaacgcttttctagaaaaagatgacatcctactagctgaacaaggtacatcctttttcggcgcatatgacttatccctatacaagggaaatcagtttatcggtcagcctttatgggggtcaatagggtatacttttccatctttactaggaagtcaactagcagacatgcataggagaaacattttgcttataggcgatggtagtttacaacttactgttcaagccctaagtacaatgattagaaaggatatcaaaccaatcattttcgttatcaataacgacggttacaccgtcgaaagacttatccacggcatggaagagccatacaatgatatccaaatgtggaactacaagcaattgccagaagtatttggtggaaaagatactgtaaaagttcatgatgctaaaacctccaacgaactgaaaactgtaatggattctgttaaagcagacaaagatcacatgcatttcattgaagtgcatatggcagtagaggacgccccaaagaagttgattgatatagctaaagcctttagtgatgctaacaagtaa

SEQ ID NO: 72 - DNA, 1647 bp, Listeria grayi
atgtacaccgtcggccaatacttagtagaccgcttagaagagatcggcatcgataaggtttttggtgtcccgggtgactacaacctgacctttttggactacatccagaaccacgaaggtctgagctggcaaggtaatacgaatgaactgaatgccgcgtacgcagctgatggctatgctcgtgaacgcggtgttagcgctttggtcacgaccttcggcgttggtgagctgtccgcaatcaatggcaccgcaggtagcttcgcggagcaagttccggtgattcatatcgtgggcagcccgaccatgaatgttcagagcaacaagaaactggttcatcacagcctgggtatgggcaactttcacaacttcagcgagatggcgaaagaagtcaccgccgcaaccacgatgctgacggaagagaatgcggcgtcggagattgatcgtgttctggaaaccgccctgctggagaaacgcccagtgtacatcaatctgccgatcgacattgctcacaaggcgatcgtcaagccggcgaaagccctgcaaaccgagaagagctctggcgagcgtgaggcacaactggcggagatcattctgagccatctggagaaggctgcacagccgattgtgattgcgggtcacgagatcgcgcgcttccagatccgtgagcgtttcgagaattggattaatcaaacgaaactgccggtgaccaatctggcctacggcaagggtagcttcaacgaagaaaacgagcatttcattggtacctattatcctgcatttagcgataagaacgtgctggactacgtggataactccgactttgtcctgcactttggtggtaaaatcattgataacagcacctccagcttctcccaaggcttcaaaaccgagaacaccctgactgcggcgaacgatatcattatgctgccggacggtagcacgtattctggtattagcctgaatggcctgctggccgagctggaaaaactgaatttcacgtttgccgacaccgcagcaaagcaggcggagttggcggtgtttgagccgcaggctgaaaccccgttgaaacaggaccgttttcaccaggcggtgatgaattttctgcaagctgacgatgtcctggttacggaacagggcacctcttcttttggcttgatgctggcgcctctgaaaaagggtatgaacttgatctcgcaaacgctgtggggtagcattggttacacgttgccggcgatgattggtagccaaattgcggcaccggagcgtcgtcatatcctgagcattggtgatggtagctttcagctgactgcgcaggaaatgagcaccattttccgtgagaaactgaccccagtcatcttcatcattaacaatgatggctataccgttgagcgtgcgatccatggcgaagatgaaagctataacgacattccgacgtggaacttgcaactggtggcggaaaccttcggtggtgacgccgaaaccgtcgacactcacaatgtgttcacggagactgatttcgccaacaccctggcggcaattgacgcgacgccgcagaaagcacacgttgtggaagttcacatggaacaaatggatatgccggagagcctgcgccagatcggtctggcactgtccaagcagaatagctaa

SEQ ID NO: 73 - protein, 312 aa, Saccharomyces cerevisiae
MPATLKNSSATLKLNTGASIPVLGFGTWRSVDNNGYHSVIAALKAGYRHIDAAAIYLNEEEVGRAIKDSGVPREEIFITTKLWGTEQRDPEAALNKSLKRLGLDYVDLYLMHWPVPLKTDRVTDGNVLCIPTLEDGTVDIDTKEWNFIKTWELMQELPKTGKTKAVGVSNFSINNIKELLESPNNKVVPATNQIEIHPLLPQDELIAFCKEKGIVVEAYSPFGSANAPLLKEQAIIDMAKKHGVEPAQLIISWSIQRGYVVLAKSVNPERIVSNFKIFTLPEDDFKTISNLSKVHGTKRVVDMKWGSFPIFQ

SEQ ID NO: 74 - DNA, 939 bp, Saccharomyces cerevisiae
atgcctgctacgttaaagaattcttctgctacattaaaactaaatactggtgcctccattccagtgttgggtttcggcacttggcgttccgttgacaataacggttaccattctgtaattgcagctttgaaagctggatacagacacattgatgctgcggctatctatttgaatgaagaagaagttggcagggctattaaagattccggagtccctcgtgaggaaatttttattactactaagctttggggtacggaacaacgtgatccggaagctgctctaaacaagtctttgaaaagactaggcttggattatgttgacctatatctgatgcattggccagtgcctttgaaaaccgacagagttactgatggtaacgttctgtgcattccaacattagaagatggcactgttgacatcgatactaaggaatggaattttatcaagacgtgggagttgatgcaagagttgccaaagacgggcaaaactaaagccgttggtgtctctaatttttctattaacaacattaaagaattattagaatctccaaataacaaggtggtaccagctactaatcaaattgaaattcatccattgctaccacaagacgaattgattgccttttgtaaggaaaagggtattgttgttgaagcctactcaccatttgggagtgctaatgctcctttactaaaagagcaagcaattattgatatggctaaaaagcacggcgttgagccagcacagcttattatcagttggagtattcaaagaggctacgttgttctggccaaatcggttaatcctgaaagaattgtatccaattttaagattttcactctgcctgaggatgatttcaagactattagtaacctatccaaagtgcatggtacaaagagagtcgttgatatgaagtggggatccttcccaattttccaatga

SEQ ID NO: 75 - protein, 360 aa, Saccharomyces cerevisiae
MSYPEKFEGIAIQSHEDWKNPKKTKYDPKPFYDHDIDIKIEACGVCGSDIHCAAGHWGNMKMPLVVGHEIVGKVVKLGPKSNSGLKVGQRVGVGAQVFSCLECDRCKNDNEPYCTKFVTTYSQPYEDGYVSQGGYANYVRVHEHFVVPIPENIPSHLAAPLLCGGLTVYSPLVRNGCGPGKKVGIVGLGGIGSMGTLISKAMGAETYVISRSSRKREDAMKMGADHYIATLEEGDWGEKYFDTFDLIVVCASSLTDIDFNIMPKAMKVGGRIVSISIPEQHEMLSLKPYGLKAVSISYSALGSIKELNQLLKLVSEKDIKIWVETLPVGEAGVHEAFERMEKGDVRYRFTLVGYDKEFSD

SEQ ID NO: 76 - DNA, 1083 bp, Saccharomyces cerevisiae
ctagtctgaaaattctttgtcgtagccgactaaggtaaatctatatctaacgtcacccttttccatcctttcgaaggcttcatggacgccggcttcaccaacaggtaatgtttccacccaaattttgatatctttttcagagactaatttcaagagttggttcaattctttgatggaacctaaagcactgtaagaaatggagacagcctttaagccatatggctttagcgataacatttcgtgttgttctggtatagagattgagacaattctaccaccaaccttcatagcctttggcataatgttgaagtcaatgtcggtaagggaggaagcacagactacaatcaggtcgaaggtgtcaaagtacttttcaccccaatcaccttcttctaatgtagcaatgtagtgatcggcgcccatcttcattgcatcttctctttttctcgaagaacgagaaataacatacgtctctgcccccatggctttggaaatcaatgtacccatactgccgataccaccaagaccaactataccaacttttttacctggaccgcaaccgttacgaaccaatggagagtacacagtcaaaccaccacataatagtggagcagccaaatgtgatggaatattctctgggataggcaccacaaaatgttcatgaactctgacgtagtttgcatagccaccctgcgacacatagccgtcttcataaggctgactgtatgtggtaacaaacttggtgcagtatggttcattatcattcttacaacggtcacattccaagcatgaaaagacttgagcacctacaccaacacgttgaccgactttcaacccactgtttgacttgggccctagcttgacaactttaccaacgatttcatgaccaacgactagcggcatcttcatattgccccaatgaccagctgcacaatgaatatcactaccgcagacaccacatgcttcgatcttaatgtcaatgtcatgatcgtaaaatggttttgggtcatactttgtcttctttgggtttttccaatcttcgtgtgattgaatagcgataccttcaaatttctcaggataagacat

SEQ ID NO: 77 - protein, 387 aa, Escherichia coli
MNNFNLHTPTRILFGKGAIAGLREQIPHDARVLITYGGGSVKKTGVLDQVLDALKGMDVLEFGGIEPNPAYETLMNAVKLVREQKVTFLLAVGGGSVLDGTKFIAAAANYPENIDPWHILQTGGKEIKSAIPMGCVLTLPATGSESNAGAVISRKTTGDKQAFHSAHVQPVFAVLDPVYTYTLPPRQVANGVVDAFVHTVEQYVTKPVDAKIQDRFAEGILLTLIEDGPKALKEPENYDVRANVMWAATQALNGLIGAGVPQDWATHMLGHELTAMHGLDHAQTLAIVLPALWNEKRDTKRAKLLQYAERVWNITEGSDDERIDAAIAATRNFFEQLGVPTHLSDYGLDGSSIPALLKKLEEHGMTQLGENHDITLDVSRRIYEAAR

SEQ ID NO: 78 - protein, 387 aa, Escherichia coli; identical to SEQ ID NO: 77

SEQ ID NO: 79 - protein, 389 aa, Clostridium acetobutylicum
MLSFDYSIPTKVFFGKGKIDVIGEEIKKYGSRVLIVYGGGSIKRNGIYDRATAILKENNIAFYELSGVEPNPRITTVKKGIEICRENNVDLVLAIGGGSAIDCSKVIAAGVYYDGDTWDMVKDPSKITKVLPIASILTLSATGSEMDQIAVISNMETNEKLGVGHDDMRPKFSVLDPTYTFTVPKNQTAAGTADIMSHTFESYFSGVEGAYVQDGIAEAILRTCIKYGKIAMEKTDDYEARANLMWASSLAINGLLSLGKDRKWSCHPMEHELSAYYDITHGVGLAILTPNWMEYILNDDTLHKFVSYGINVWGIDKNKDNYEIAREAIKNTREYFNSLGIPSKLREVGIGKDKLELMAKQAVRNSGGTIGSLRPINAEDVLEIFKKSY

SEQ ID NO: 80 - DNA, 1170 bp, Clostridium acetobutylicum
ttaataagattttttaaatatctcaagaacatcctctgcatttattggtcttaaacttcctattgttcctccagaatttctaacagcttgctttgccattagttctagtttatcttttcctattccaacttctctaagctttgaaggaatacccaatgaattaaagtattctctcgtatttttaatagcctctcgtgctatttcatagttatctttgttcttgtctattccccaaacatttattccataagaaacaaatttatgaagtgtatcgtcatttagaatatattccatccaattaggtgttaaaattgcaagtcctacaccatgtgttatatcataatatgcacttaactcgtgttccataggatgacaactccattttctatccttaccaagtgataatagaccatttatagctaaacttgaagcccacatcaaattagctctagcctcgtaatcatcagtcttctccattgctatttttccatactttatacatgttcttaagattgcttctgctataccgtcctgcacataagcaccttcaacaccactaaagtaagattcaaaggtgtgactcataatgtcagctgttcccgctgctgtttgatttttaggtactgtaaaagtatatgtaggatctaacactgaaaatttaggtctcatatcatcatgtcctactccaagcttttcattagtctccatatttgaaattactgcaatttgatccatttcagaccctgttgctgaaagagtaagtatacttgcaattggaagaactttagttattttagatggatctttaaccatgtcccatgtatcgccatcataataaactccagctgcaattaccttagaacagtctattgcacttcctccccctattgctaatactaaatccacattattttctctacatatttctatgcctttttttactgttgttatcctaggatttggctctactcctgaaagttcatagaaagctatattgttttcttttaatatagctgttgctctatcatatataccgttcctttttatacttcctccgccataaactataagcactcttgagccatatttcttaatttcttctccaattacgtctatttttccttttccaaaaaaaactttagttggtattgaataatcaaaacttagcat

SEQ ID NO: 81 - protein, 390 aa, Clostridium acetobutylicum
MVDFEYSIPTRIFFGKDKINVLGRELKKYGSKVLIVYGGGSIKRNGIYDKAVSILEKNSIKFYELAGVEPNPRVTTVEKGVKICRENGVEVVLAIGGGSAIDCAKVIAAACEYDGNPWDIVLDGSKIKRVLPIASILTIAATGSEMDTWAVINNMDTNEKLIAAHPDMAPKFSILDPTYTYTVPTNQTAAGTADIMSHIFEVYFSNTKTAYLQDRMAEALLRTCIKYGGIALEKPDDYEARANLMWASSLAINGLLTYGKDTNWSVHLMEHELSAYYDITHGVGLAILTPNWMEYILNNDTVYKFVEYGVNVWGIDKEKNHYDIAHQAIQKTRDYFVNVLGLPSRLRDVGIEEEKLDIMAKESVKLTGGTIGNLRPVNASEVLQIFKKSV

SEQ ID NO: 82 - DNA, 1173 bp, Clostridium acetobutylicum
gtggttgatttcgaatattcaataccaactagaatttttttcggtaaagataagataaatgtacttggaagagagcttaaaaaatatggttctaaagtgcttatagtttatggtggaggaagtataaagagaaatggaatatatgataaagctgtaagtatacttgaaaaaaacagtattaaattttatgaacttgcaggagtagagccaaatccaagagtaactacagttgaaaaaggagttaaaatatgtagagaaaatggagttgaagtagtactagctataggtggaggaagtgcaatagattgcgcaaaggttatagcagcagcatgtgaatatgatggaaatccatgggatattgtgttagatggctcaaaaataaaaagggtgcttcctatagctagtatattaaccattgctgcaacaggatcagaaatggatacgtgggcagtaataaataatatggatacaaacgaaaaactaattgcggcacatccagatatggctcctaagttttctatattagatccaacgtatacgtataccgtacctaccaatcaaacagcagcaggaacagctgatattatgagtcatatatttgaggtgtattttagtaatacaaaaacagcatatttgcaggatagaatggcagaagcgttattaagaacttgtattaaatatggaggaatagctcttgagaagccggatgattatgaggcaagagccaatctaatgtgggcttcaagtcttgcgataaatggacttttaacatatggtaaagacactaattggagtgtacacttaatggaacatgaattaagtgcttattacgacataacacacggcgtagggcttgcaattttaacacctaattggatggagtatattttaaataatgatacagtgtacaagtttgttgaatatggtgtaaatgtttggggaatagacaaagaaaaaaatcactatgacatagcacatcaagcaatacaaaaaacaagagattactttgtaaatgtactaggtttaccatctagactgagagatgttggaattgaagaagaaaaattggacataatggcaaaggaatcagtaaagcttacaggaggaaccataggaaacctaagaccagtaaacgcctccgaagtcctacaaatattcaaaaaatctgtgtaa

SEQ ID NO: 83 - protein, 330 aa, Bacillus subtilis
MSTNRHQALGLTDQEAVDMYRTMLLARKIDERMWLLNRSGKIPFVISCQGQEAAQVGAAFALDREMDYVLPYYRDMGVVLAFGMTAKDLMMSGFAKAADPNSGGRQMPGHFGQKKNRIVTGSSPVTTQVPHAVGIALAGRMEKKDIAAFVTFGEGSSNQGDFHEGANFAAVHKLPVIFMCENNKYAISVPYDKQVACENISDRAIGYGMPGVTVNGNDPLEVYQAVKEARERARRGEGPTLIETISYRLTPHSSDDDDSSYRGREEVEEAKKSDPLLTYQAYLKETGLLSDEIEQTMLDEIMAIVNEATDEAENAPYAAPESALDYVYAK

SEQ ID NO: 84 - DNA, 993 bp, Bacillus subtilis
atgagtacaaaccgacatcaagcactagggctgactgatcaggaagccgttgatatgtatagaaccatgctgttagcaagaaaaatcgatgaaagaatgtggctgttaaaccgttctggcaaaattccatttgtaatctcttgtcaaggacaggaagcagcacaggtaggagcggctttcgcacttgaccgtgaaatggattatgtattgccgtactacagagacatgggtgtcgtgctcgcgtttggcatgacagcaaaggacttaatgatgtccgggtttgcaaaagcagcagatccgaactcaggaggccgccagatgccgggacatttcggacaaaagaaaaaccgcattgtgacgggatcatctccggttacaacgcaagtgccgcacgcagtcggtattgcgcttgcgggacgtatggagaaaaaggatatcgcagcctttgttacattcggggaagggtcttcaaaccaaggcgatttccatgaaggggcaaactttgccgctgtccataagctgccggttattttcatgtgtgaaaacaacaaatacgcaatctcagtgccttacgataagcaagtcgcatgtgagaacatttccgaccgtgccataggctatgggatgcctggcgtaactgtgaatggaaatgatccgctggaagtttatcaagcggttaaagaagcacgcgaaagggcacgcagaggagaaggcccgacattaattgaaacgatttcttaccgccttacaccacattccagtgatgacgatgacagcagctacagaggccgtgaagaagtagaggaagcgaaaaaaagtgatcccctgcttacttatcaagcttacttaaaggaaacaggcctgctgtccgatgagatagaacaaaccatgctggatgaaattatggcaatcgtaaatgaagcgacggatgaagcggagaacgccccatatgcagctcctgagtcagcgcttgattatgtttatgcgaagtag

SEQ ID NO: 85 - protein, 327 aa, Bacillus subtilis
MSVMSYIDAINLAMKEEMERDSRVFVLGEDVGRKGGVFKATAGLYEQFGEERVMDTPLAESAIAGVGIGAAMYGMRPIAEMQFADFIMPAVNQIISEAAKIRYRSNNDWSCPIVVRAPYGGGVHGALYHSQSVEAIFANQPGLKIVMPSTPYDAKGLLKAAVRDEDPVLFFEHKRAYRLIKGEVPADDYVLPIGKADVKREGDDITVITYGLCVHFALQAAERLEKDGISAHVVDLRTVYPLDKEAIIEAASKTGKVLLVTEDTKEGSIMSEVAAIISEHCLFDLDAPIKRLAGPDIPAMPYAPTMEKYFMVNPDKVEAAMRELAEF

SEQ ID NO: 86 - DNA, 984 bp, Bacillus subtilis
atgtcagtaatgtcatatattgatgcaatcaatttggcgatgaaagaagaaatggaacgagattctcgcgttttcgtccttggggaagatgtaggaagaaaaggcggtgtgtttaaagcgacagcgggactctatgaacaatttggggaagagcgcgttatggatacgccgcttgctgaatctgcaatcgcaggagtcggtatcggagcggcaatgtacggaatgagaccgattgctgaaatgcagtttgctgatttcattatgccggcagtcaaccaaattatttctgaagcggctaaaatccgctaccgcagcaacaatgactggagctgtccgattgtcgtcagagcgccatacggcggaggcgtgcacggagccctgtatcattctcaatcagtcgaagcaattttcgccaaccagcccggactgaaaattgtcatgccatcaacaccatatgacgcgaaagggctcttaaaagccgcagttcgtgacgaagaccccgtgctgttttttgagcacaagcgggcataccgtctgataaagggcgaggttccggctgatgattatgtcctgccaatcggcaaggcggacgtaaaaagggaaggcgacgacatcacagtgatcacatacggcctgtgtgtccacttcgccttacaagctgcagaacgtctcgaaaaagatggcatttcagcgcatgtggtggatttaagaacagtttacccgcttgataaagaagccatcatcgaagctgcgtccaaaactggaaaggttcttttggtcacagaagatacaaaagaaggcagcatcatgagcgaagtagccgcaattatatccgagcattgtctgttcgacttagacgcgccgatcaaacggcttgcaggtcctgatattccggctatgccttatgcgccgacaatggaaaaatactttatggtcaaccctgataaagtggaagcggcgatgagagaattagcggagttttaa

SEQ ID NO: 87 - protein, 424 aa, Bacillus subtilis
MAIEQMTMPQLGESVTEGTISKWLVAPGDKVNKYDPIAEVMTDKVNAEVPSSFTGTITELVGEEGQTLQVGEMICKIETEGANPAEQKQEQPAASEAAENPVAKSAGAADQPNKKRYSPAVLRLAGEHGIDLDQVTGTGAGGRITRKDIQRLIETGGVQEQNPEELKTAAPAPKSASKPEPKEETSYPASAAGDKEIPVTGVRKAIASNMKRSKTEIPHAWTMMEVDVTNMVAYRNSIKDSFKKTEGFNLTFFAFFVKAVAQALKEFPQMNSMWAGDKIIQKKDINISIAVATEDSLFVPVIKNADEKTIKGIAKDITGLAKKVRDGKLTADDMQGGTFTVNNTGSFGSVQSMGIINYPQAAILQVESIVKRPVVMDNGMIAVRDMVNLCLSLDHRVLDGLVCGRFLGRVKQILESIDEKTSVY

SEQ ID NO: 88 - DNA, 1275 bp, Bacillus subtilis
atggcaattgaacaaatgacgatgccgcagcttggagaaagcgtaacagaggggacgatcagcaaatggcttgtcgcccccggtgataaagtgaacaaatacgatccgatcgcggaagtcatgacagataaggtaaatgcagaggttccgtcttcttttactggtacgataacagagcttgtgggagaagaaggccaaaccctgcaagtcggagaaatgatttgcaaaattgaaacagaaggcgcgaatccggctgaacaaaaacaagaacagccagcagcatcagaagccgctgagaaccctgttgcaaaaagtgctggagcagccgatcagcccaataaaaagcgctactcgccagctgttctccgtttggccggagagcacggcattgacctcgatcaagtgacaggaactggtgccggcgggcgcatcacacgaaaagatattcagcgcttaattgaaacaggcggcgtgcaagaacagaatcctgaggagctgaaaacagcagctcctgcaccgaagtctgcatcaaaacctgagccaaaagaagagacgtcatatcctgcgtctgcagccggtgataaagaaatccctgtcacaggtgtaagaaaagcaattgcttccaatatgaagcgaagcaaaacagaaattccgcatgcttggacgatgatggaagtcgacgtcacaaatatggttgcatatcgcaacagtataaaagattcttttaagaagacagaaggctttaatttaacgttcttcgccttttttgtaaaagcggtcgctcaggcgttaaaagaattcccgcaaatgaatagcatgtgggcgggggacaaaattattcagaaaaaggatatcaatatttcaattgcagttgccacagaggattctttatttgttccggtgattaaaaacgctgatgaaaaaacaattaaaggcattgcgaaagacattaccggcctagctaaaaaagtaagagacggaaaactcactgcagatgacatgcagggaggcacgtttaccgtcaacaacacaggttcgttcgggtctgttcagtcgatgggcattatcaactaccctcaggctgcgattcttcaagtagaatccatcgtcaaacgcccggttgtcatggacaatggcatgattgctgtcagagacatggttaatctgtgcctgtcattagatcacagagtgcttgacggtctcgtgtgcggacgattcctcggacgagtgaaacaaattttagaatcgattgacgagaagacatctgtttactaa

SEQ ID NO: 89 - protein, 474 aa, Bacillus subtilis
MATEYDVVILGGGTGGYVAAIRAAQLGLKTAVVEKEKLGGTCLHKGCIPSKALLRSAEVYRTAREADQFGVETAGVSLNFEKVQQRKQAVVDKLAAGVNHLMKKGKIDVYTGYGRILGPSIFSPLPGTISVERGNGEENDMLIPKQVIIATGSRPRMLPGLEVDGKSVLTSDEALQMEELPQSIIIVGGGVIGIEWASMLHDFGVKVTVIEYADRILPTEDLEISKEMESLLKKKGIQFITGAKVLPDTMTKTSDDISIQAEKDGETVTYSAEKMLVSIGRQANIEGIGLENTDIVTENGMISVNESCQTKESHIYAIGDVIGGLQLAHVASHEGIIAVEHFAGLNPHPLDPTLVPKCIYSSPEAASVGLTEDEAKANGHNVKIGKFPFMAIGKALVYGESDGFVKIVADRDTDDILGVHMIGPHVTDMISEAGLAKVLDATPWEVGQTIHPHPTLSEAIGEAALAADGKAIHF

SEQ ID NO: 90 - DNA, 1425 bp, Bacillus subtilis
atggcaactgagtatgacgtagtcattctgggcggcggtaccggcggttatgttgcggccatcagagccgctcagctcggcttaaaaacagccgttgtggaaaaggaaaaactcgggggaacatgtctgcataaaggctgtatcccgagtaaagcgctgcttagaagcgcagaggtataccggacagctcgtgaagccgatcaattcggagtggaaacggctggcgtgtccctcaactttgaaaaagtgcagcagcgtaagcaagccgttgttgataagcttgcagcgggtgtaaatcatttaatgaaaaaaggaaaaattgacgtgtacaccggatatggacgtatccttggaccgtcaatcttctctccgctgccgggaacaatttctgttgagcggggaaatggcgaagaaaatgacatgctgatcccgaaacaagtgatcattgcaacaggatcaagaccgagaatgcttccgggtcttgaagtggacggtaagtctgtactgacttcagatgaggcgctccaaatggaggagctgccacagtcaatcatcattgtcggcggaggggttatcggtatcgaatgggcgtctatgcttcatgattttggcgttaaggtaacggttattgaatacgcggatcgcatattgccgactgaagatctagagatttcaaaagaaatggaaagtcttcttaagaaaaaaggcatccagttcataacaggggcaaaagtgctgcctgacacaatgacaaaaacatcagacgatatcagcatacaagcggaaaaagacggagaaaccgttacctattctgctgagaaaatgcttgtttccatcggcagacaggcaaatatcgaaggcatcggcctagagaacaccgatattgttactgaaaatggcatgatttcagtcaatgaaagctgccaaacgaaggaatctcatatttatgcaatcggagacgtaatcggtggcctgcagttagctcacgttgcttcacatgagggaattattgctgttgagcattttgcaggtctcaatccgcatccgcttgatccgacgcttgtgccgaagtgcatttactcaagccctgaagctgccagtgtcggcttaaccgaagacgaagcaaaggcgaacgggcataatgtcaaaatcggcaagttcccatttatggcgattggaaaagcgcttgtatacggtgaaagcgacggttttgtcaaaatcgtggctgaccgagatacagatgatattctcggcgttcatatgattggcccgcatgtcaccgacatgatttctgaagcgggtcttgccaaagtgctggacgcaacaccgtgggaggtcgggcaaacgattcacccgcatccaacgctttctgaagcaattggagaagctgcgcttgccgcagatggcaaagccattcatttttaa

SEQ ID NO: 91 - protein, 410 aa, Pseudomonas putida
MNEYAPLRLHVPEPTGRPGCQTDFSYLRLNDAGQARKPPVDVDAADTADLSYSLVRVLDEQGDAQGPWAEDIDPQILRQGMRAMLKTRIFDSRMVVAQRQKKMSFYMQSLGEEAIGSGQALALNRTDMCFPTYRQQSILMARDVSLVEMICQLLSNERDPLKGRQLPIMYSVREAGFFTISGNLATQFVQAVGWAMASAIKGDTKIASAWIGDGATAESDFHTALTFAHVYRAPVILNVVNNQWAISTFQAIAGGESTTFAGRGVGCGIASLRVDGNDFVAVYAASRWAAERARRGLGPSLIEWVTYRAGPHSTSDDPSKYRPADDWSHFPLGDPIARLKQHLIKIGHWSEEEHQATTAEFEAAVIAAQKEAEQYGTLANGHIPSAASMFEDVYKEMPDHLRRQRQELGV

SEQ ID NO: 92 - DNA, 6643 bp, Pseudomonas putida
gcatgcctgcaggccgccgatgaaatggtggaaggtatcggtaggctggccctgctcatcgctgaacacgttacgcccgctgccggtatcgaccaggctctggtgaatatgcatggaactgccaggcgtgcgcgccagcggtttggccatgcacaccacggtcagcccgtgcttgagtgccacttccttgagcaggtgtttgaacaggaaggtctggtcggccagcagcagcgggtcgccatgtagcaagttgatctcgaactggctgacgcccatttcgtgcatgaaggtgtcgcgcggcaggccgagcgcggccatgcactggtacacctcattgaagaacgggcgcaggccgttgttggaactgacactgaacgccgaatggcccagctcgcggcggccgtcggtgcccagcggtggctggaacggctgctgcgggtcactgttgggggcaaacacgaagaactcaagctcggtcgccactaccggtgccagacccaacgctgcgtagcgggcgatcacggccttcagctggccccgggtggacagtgccgagggccggccatccagttcattggcatcgcagatggccagggcgcgaccgtcatcgctccagggcaagcgatgaacctggctgggttccgctaccaacgccaggtcgccgtcgtcgcagccgtagaatttcgccggcgggtagccgcccatgatgcattgcagcagcaccccacgggccatctgcaggcggcggccttcgagaaagccttcggcggtcatcaccttgccgcgtgggacgccgttgaggtcgggggtgacgcattcgatttcatcgatgccctggagctgagcgatgctcatgacgcttgtccttgttgttgtaggctgacaacaacataggctgggggtgtttaaaatatcaagcagcctctcgaacgcctggggcctcttctattcgcgcaaggtcatgccattggccggcaacggcaaggctgtcttgtagcgcacctgtttcaaggcaaaactcgagcggatattcgccacacccggcaaccgggtcaggtaatcgagaaaccgctccagcgcctggatactcggcagcagtacccgcaacaggtagtccgggtcgcccgtcatcaggtagcactccatcacctcgggccgttcggcaatttcttcctcgaagcggtgcagcgactgctctacctgtttttccaggctgacatggatgaacacattcacatccagccccaacgcctcgggcgacaacaaggtcacctgctggcggatcacccccagttcttccatggcccgcacccggttgaaacagggcgtgggcgacaggttgaccgagcgtgccagctcggcgttggtgatgcgggcgttttcctgcaggctgttgagaatgccgatatcggtacgatcgagtttgcgcatgagacaaaatcaccggttttttgtgtttatgcggaatgtttatctgccccgctcggcaaaggcaatcaacttgagagaaaaattctcctgccggaccactaagatgtaggggacgctgacttaccagtcacaagccggtactcagcggcggccgcttcagagctcacaaaaacaaatacccgagcgagcgtaaaaagcatgaacgagtacgcccccctgcgtttgcatgtgcccgagcccaccggccggccaggctgccagaccgatttttcctacctgcgcctgaacgatgcaggtcaagcccgtaaaccccctgtcgatgtcgacgctgccgacaccgccgacctgtcctacagcctggtccgcgtgctcgacgagcaaggcgacgcccaaggcccgtgggctgaagacatcgacccgcagatcctgcgccaaggcatgcgcgccatgctcaagacgcggatcttcgacagccgcatggtggttgcccagcgccagaagaagatgtccttctacatgcagagcctgggcgaagaagccatcggcagcggccaggcgctggcgcttaaccgcaccgacatgtgcttccccacctaccgtcagcaaagcatcctgatggcccgcgacgtgtcgctggtggagatgatctgccagttgctgtccaacgaacgcgaccccctcaagggccgccagctgccgatcatgtactcggtacgcgaggccggcttcttcaccatcagcggcaacctggcgacccagttcgtgcaggcggtcggctgggccatggcctcggcgatcaagggcgataccaagattgcctcggcctggatcggcgacggcgccactgccgaatcggacttccacaccgccctcacctttgcccacgtttaccgcgccccggtgatcctcaacgtggtcaacaaccagtgggccatctcaaccttccaggccatcgccggtggcgagtcgaccaccttcgccggccgtggcgtgggctgcggcatcgcttcgctgcgggtggacggcaacgacttcgtcgccgtttacgccgcttcgcgctgggctgccgaacgtgcccgccgtggtttgggcccgagcctgatcgagtgggtcacctaccgtgccggcccgcactcgacctcggacgacccgtccaagtaccgccctgccgatgactggagccacttcccgctgggtgacccgatcgcccgcctgaagcagcacctgatcaagatcggccactggtccgaagaagaacaccaggccaccacggccgagttcgaagcggccgtgattgctgcgcaaaaagaagccgagcagtacggcaccctggccaacggtcacatcccgagcgccgcctcgatgttcgaggacgtgtacaaggagatgcccgaccacctgcgccgccaacgccaggaactgggggtttgagatgaacgaccacaacaacagcatcaacccggaaaccgccatggccaccactaccatgaccatgatccaggccctgcgctcggccatggatgtcatgcttgagcgcgacgacaatgtggtggtgtacggccaggacgtcggctacttcggcggcgtgttccgctgcaccgaaggcctgcagaccaagtacggcaagtcccgcgtgttcgacgcgcccatctctgaaagcggcatcgtcggcaccgccgtgggcatgggtgcctacggcctgcgcccggtggtggaaatccagttcgctgactacttctacccggcctccgaccagatcgtttctgaaatggcccgcctgcgctaccgttcggccggcgagttcatcgccccgctgaccctgcgtatgccctgcggtggcggtatctatggcggccagacacacagccagagcccggaagcgatgttcactcaggtgtgcggcctgcgcaccgtaatgccatccaacccgtacgacgccaaaggcctgctgattgcctcgatcgaatgcgacgacccggtgatcttcctggagcccaagcgcctgtacaacggcccgttcgacggccaccatgaccgcccggttacgccgtggtcgaaacacccgcacagcgccgtgcccgatggctactacaccgtgccactggacaaggccgccatcacccgccccggcaatgacgtgagcgtgctcacctatggcaccaccgtgtacgtggcccaggtggccgccgaagaaagtggcgtggatgccgaagtgatcgacctgcgcagcctgtggccgctagacctggacaccatcgtcgagtcggtgaaaaagaccggccgttgcgtggtagtacacgaggccacccgtacttgtggctttggcgcagaactggtgtcgctggtgcaggagcactgcttccaccacctggaggcgccgatcgagcgcgtcaccggttgggacaccccctaccctcacgcgcaggaatgggcttacttcccagggccttcgcgggtaggtgcggcattgaaaaaggtcatggaggtctgaatgggcacgcacgtcatcaagatgccggacattggcgaaggcatcgcgcaggtcgaattggtggaatggttcgtcaaggtgggcgacatcatcgccgaggaccaagtggtagccgacgtcatgaccgacaaggccaccgtggaaatcccgtcgccggtcagcggcaaggtgctggccctgggtggccagccaggtgaagtgatggcggtcggcagtgagctgatccgcatcgaagtggaaggcagcggcaaccatgtggatgtgccgcaagccaagccggccgaagtgcctgcggcaccggtagccgctaaacctgaaccacagaaagacgttaaaccggcggcgtaccaggcgtcagccagccacgaggcagcgcccatcgtgccgcgccagccgggcgacaagccgctggcctcgccggcggtgcgcaaacgcgccctcgatgccggcatcgaattgcgttatgtgcacggcagcggcccggccgggcgcatcctgcacgaagacctcgacgcgttcatgagcaaaccgcaaagcgctgccgggcaaacccccaatggctatgccaggcgcaccgacagcgagcaggtgccggtgatcggcctgcgccgcaagatcgcccagcgcatgcaggacgccaagcgccgggtcgcgcacttcagctatgtggaagaaatcgacgtcaccgccctggaagccctgcgccagcagctcaacagcaagcacggcgacagccgcggcaagctgacactgctgccgttcctggtgcgcgccctggtcgtggcactgcgtgacttcccgcagataaacgccacctacgatgacgaagcgcagatcatcacccgccatggcgcggtgcatgtgggcatcgccacccaaggtgacaacggcctgatggtacccgtgctgcgccacgccgaagcgggcagcctgtgggccaatgccggtgagatttcacgcctggccaacgctgcgcgcaacaacaaggccagccgcgaagagctgtccggttcgaccattaccctgaccagcctcggcgccctgggcggcatcgtcagcacgccggtggtcaacaccccggaagtggcgatcgtcggtgtcaaccgcatggttgagcggcccgtggtgatcgacggccagatcgtcgtgcgcaagatgatgaacctgtccagctcgttcgaccaccgcgtggtcgatggcatggacgccgccctgttcatccaggccgtgcgtggcctgctcgaacaacccgcctgcctgttcgtggagtgagcatgcaacagactatccagacaaccctgttgatcatcggcggcggccctggcggctatgtggcggccatccgcgccgggcaactgggcatccctaccgtgctggtggaaggccaggcgctgggcggtacctgcctgaacatcggctgcattccgtccaaggcgctgatccatgtggccgagcagttccaccaggcctcgcgctttaccgaaccctcgccgctgggcatcagcgtggcttcgccacgcctggacatcggccagagcgtggcctggaaagacggcatcgtcgatcgcctgaccactggtgtcgccgccctgctgaaaaagcacggggtgaaggtggtgcacggctgggccaaggtgcttgatggcaagcaggtcgaggtggatggccagcgcatccagtgcgagcacctgttgctggccacgggctccagcagtgtcgaactgccgatgctgccgttgggtgggccggtgatttcctcgaccgaggccctggcaccgaaagccctgccgcaacacctggtggtggtgggcggtggctacatcggcctggagctgggtatcgcctaccgcaagctcggcgcgcaggtcagcgtggtggaagcgcgcgagcgcatcctgccgacttacgacagcgaactgaccgccccggtggccgagtcgctgaaaaagctgggtatcgccctgcaccttggccacagcgtcgaaggttacgaaaatggctgcctgctggccaacgatggcaagggcggacaactgcgcctggaagccgaccgggtgctggtggccgtgggccgccgcccacgcaccaagggcttcaacctggaatgcctggacctgaagatgaatggtgccgcgattgccatcgacgagcgctgccagaccagcatgcacaacgtctgggccatcggcgacgtggccggcgaaccgatgctggcgcaccgggccatggcccagggcgagatggtggccgagatcatcgccggcaaggcacgccgcttcgaacccgctgcgatagccgccgtgtgcttcaccgacccggaagtggtcgtggtcggcaagacgccggaacaggccagtcagcaaggcctggactgcatcgtcgcgcagttcccgttcgccgccaacggccgggccatgagcctggagtcgaaaagcggtttcgtgcgcgtggtcgcgcggcgtgacaaccacctgatcctgggctggcaagcggttggcgtggcggtttccgagctgtccacggcgtttgcccagtcgctggagatgggtgcctgcctggaggatgtggccggtaccatccatgcccacccgaccctgggtgaagcggtacaggaagcggcactgcgtgccctgggccacgccctgcatatctgacactgaagcggccgaggccgatttggcccgccgcgccgagaggcgctgcgggtcttttttatacctg

SEQ ID NO: 93 - protein, 352 aa, Pseudomonas putida
MNDHNNSINPETAMATTTMTMIQALRSAMDVMLERDDNVVVYGQDVGYFGGVFRCTEGLQTKYGKSRVFDAPISESGIVGTAVGMGAYGLRPVVEIQFADYFYPASDQIVSEMARLRYRSAGEFIAPLTLRMPCGGGIYGGQTHSQSPEAMFTQVCGLRTVMPSNPYDAKGLLIASIECDDPVIFLEPKRLYNGPFDGHHDRPVTPWSKHPHSAVPDGYYTVPLDKAAITRPGNDVSVLTYGTTVYVAQVAAEESGVDAEVIDLRSLWPLDLDTIVESVKKTGRCVVVHEATRTCGFGAELVSLVQEHCFHHLEAPIERVTGWDTPYPHAQEWAYFPGPSRVGAALKKVMEV

SEQ ID NO: 94 - DNA, 6643 bp, Pseudomonas putida; identical to SEQ ID NO: 92

SEQ ID NO: 95 - protein, 423 aa, Pseudomonas putida
MGTHVIKMPDIGEGIAQVELVEWFVKVGDIIAEDQVVADVMTDKATVEIPSPVSGKVLALGGQPGEVMAVGSELIRIEVEGSGNHVDVPQAKPAEVPAAPVAAKPEPQKDVKPAAYQASASHEAAPIVPRQPGDKPLASPAVRKRALDAGIELRYVHGSGPAGRILHEDLDAFMSKPQSAAGQTPNGYARRTDSEQVPVIGLRRKIAQRMQDAKRRVAHFSYVEEIDVTALEALRQQLNSKHGDSRGKLTLLPFLVRALVVALRDFPQINATYDDEAQIITRHGAVHVGIATQGDNGLMVPVLRHAEAGSLWANAGEISRLANAARNNKASREELSGSTITLTSLGALGGIVSTPVVNTPEVAIVGVNRMVERPVVIDGQIVVRKMMNLSSSFDHRVVDGMDAALFIQAVRGLLEQPACLFVE

SEQ ID NO: 96 - DNA, 6643 bp, Pseudomonas putida; identical to SEQ ID NO: 92

SEQ ID NO: 97 - protein, 459 aa, Pseudomonas putida
MQQTIQTTLLIIGGGPGGYVAAIRAGQLGIPTVLVEGQALGGTCLNIGCIPSKALIHVAEQFHQASRFTEPSPLGISVASPRLDIGQSVAWKDGIVDRLTTGVAALLKKHGVKVVHGWAKVLDGKQVEVDGQRIQCEHLLLATGSSSVELPMLPLGGPVISSTEALAPKALPQHLVVVGGGYIGLELGIAYRKLGAQVSVVEARERILPTYDSELTAPVAESLKKLGIALHLGHSVEGYENGCLLANDGKGGQLRLEADRVLVAVGRRPRTKGFNLECLDLKMNGAAIAIDERCQTSMHNVWAIGDVAGEPMLAHRAMAQGEMVAEIIAGKARRFEPAAIAAVCFTDPEVVVVGKTPEQASQQGLDCIVAQFPFAANGRAMSLESKSGFVRVVARRDNHLILGWQAVGVAVSELSTAFAQSLEMGACLEDVAGTIHAHPTLGEAVQEAALRALGHALHI

SEQ ID NO: 98 - DNA, 6643 bp, Pseudomonas putida; identical to SEQ ID NO: 92

SEQ ID NO: 99 - protein, 468 aa, Clostridium beijerinckii
MNKDTLIPTTKDLKLKTNVENINLKNYKDNSSCFGVFENVENAINSAVHAQKILSLHYTKEQREKIITEIRKAALENKEVLATMILEETHMGRYEDKILKHELVAKYTPGTEDLTTTAWSGDNGLTVVEMSPYGVIGAITPSTNPTETVICNSIGMIAAGNAVVFNGHPGAKKCVAFAIEMINKAIISCGGPENLVTTIKNPTMESLDAIIKHPLIKLLCGTGGPGMVKTLLNSGKKAIGAGAGNPPVIVDDTADIEKAGKSIIEGCSFDNNLPCIAEKEVFVFENVADDLISNMLKNNAVIINEDQVSKLIDLVLQKNNETQEYFINKKWVGKDAKLFSDEIDVESPSNIKCIVCEVNANHPFVMTELMMPILPIVRVKDIDEAVKYTKIAEQNRKHSAYIYSKNIDNLNRFEREIDTTIFVKNAKSFAGVGYEAEGFTTFTIAGSTGEGITSARNFTRQRRCVLAG

SEQ ID NO: 100 - DNA, 6558 bp, Clostridium beijerinckii
aagcttaaaatatccataggctattgttaataagactatagcgcttaatactctaagcgcaccatctaaaaaattatacataggaattggataaactccaatcttctccataatacttttcataggtgaaattgatattataattaaggctgcataaagcaaactcatatctccaataaatgtcactatcataggtaatttccttttcatgttcacatactcccccgtattctataataatttacaataaacttccatcacaaataaattataacatatattgtaaatatagttttattattcgcatatttatagataaacaatatataacttagacttatgcaataacctaccgaaagtaaaaacattgttatttcacaggactatgaaaatttcgctgaaagtactaaattgcaggttgcaccactaatgcttgctcccaatttcattgtgacaagcattagttgaacaacctacaattaagagcctttaacagctcatttccaatgcctgctacataaaaatgtttctactttctaatatggtatttacttcaaagtgtaaatcaaattcttaagttgtttatctatatagggttccatattgataacaatacatatctactgtttcaatttcatgaataccagcgatattgaaattttgtaagtttgaatatcattgtgaaaccctatatatcaaatacaatctcaaaattatacaaaaagatcccaacttcacaatatgaatttgagatcttctatcttaacttcttcaatatttttaagattatttatactgcgtgcaaatcttctataagtatcaattatcagctatgtacattgatagtggacttgtaatctgaacagcttatatatttacacttttaagttctcttccactaacccctgctttgaaacttctcataaacaaatcgaaagtacctttaattagctgtgcattctcaaactcagaatttaacttaagtacttcaattgccgcttcgatagtatagagctctccttctgaagcaccttttcttaaagtatattctgatttattaattggatttaatgaaattcttggaagcttctttaagtagtcgctctttcttagtatcttctctgcttctttccatgtgccatctaagataataaatgctggaattttttctgaatctttacatttagactttctttctagaggttcatcatcatccataggaaataatacacgtatttcataatcatcgctattaatatattcaattaatttttcaggagtctttactctctcccaaagaattaactcagttgattctggattcaccaatttcaataatctagcggtatttgaaggcctactaaattctctttctgttgataatatcaatatctttgcttttgtctctattttaggcacaatatcgcagatacaatttattattggcaacccacatttattgcagctctcatataacttagtaatttgcttaactttaaattcagactccattttacctccattattagttggttagtgtgtcatatcttcttgctattactaactgattataacatatgtattcaatatatcactcctagttttcaaagcactggcaatacgaattacaaattaatttctggatttatgtcagtatttcattaataaaaggtcggacttttaagatacttgttttagctattgatcatatttattaaagactatgcatttaatgtataattataatgaatattatcaataatatttattttatattacaatcttacagtctttattctaaatttcactcaaataccaaacgagctttattcataaacaatatataacaataattccaaaataatacgatattttatctgtaacagccatataaaaaaaatatcatatagtcttgtcatttgataacgttttgtcttccttatatttactttttcggtttaataggttgattctgtaaattttagtgataacatatatttgatgacattaaaaatttaatatttcatataaatttttaatgtctattaatttttaaatcacaaggaggaatagttcatgaataaagacacactaatacctacaactaaagatttaaaattaaaaacaaatgttgaaaacattaatttaaagaactacaaggataattcttcatgtttcggagtattcgaaaatgttgaaaatgctataaacagcgctgtacacgcgcaaaagatattatcccttcattatacaaaagaacaaagagaaaaaatcataactgagataagaaaggccgcattagaaaataaagaggttttagctaccatgattctggaagaaacacatatgggaaggtatgaagataaaatattaaagcatgaattagtagctaaatatactcctggtacagaagatttaactactactgcttggtcaggtgataatggtcttacagttgtagaaatgtctccatatggcgttataggtgcaataactccttctacgaatccaactgaaactgtaatatgtaatagcatcggcatgatagctgctggaaatgctgtagtatttaacggacacccaggcgctaaaaaatgtgttgcttttgctattgaaatgataaataaagcaattatttcatgtggcggtcctgagaatttagtaacaactataaaaaatccaactatggaatccctagatgcaattattaagcatcctttaataaaacttctttgcggaactggaggtccaggaatggtaaaaaccctcttaaattctggcaagaaagctataggtgctggtgctggaaatccaccagttattgtagatgataccgctgatatagaaaaggctggtaagagtatcattgaaggctgttcttttgataataatttaccttgtattgcagaaaaagaagtatttgtttttgagaatgttgcagatgatttaatatctaacatgctaaaaaataatgctgtaattataaatgaagatcaagtatcaaaattaatagatttagtattacaaaaaaataatgaaactcaagaatactttataaacaaaaaatgggtaggaaaagatgcaaaattattctcagatgaaatagatgttgagtctccttcaaatattaaatgcatagtctgcgaagtaaatgcaaatcatccatttgtcatgacagaactcatgatgccaatattaccaattgtaagagttaaagatatagatgaagctgttaaatatacaaagatagcagaacaaaatagaaaacatagtgcctatatttattctaaaaatatagacaacctaaatagatttgaaagagaaattgatactactatttttgtaaagaatgctaaatcttttgctggtgttggttatgaagctgaaggatttacaactttcactattgctggatctactggtgaaggcataacctctgcaagaaattttacaagacaaagaagatgtgtacttgccggctaacttcttgctaaatttatacatttattcacataactttaatatgcaatgttcccacaaaatattaaaaactatttagaagggagatattaaatgaataaattagtaaaattaacagatttaaagcgcattttcaaagatggtatgacaattatggttgggggttttttagattgtggaactcctgaaaatattatagatatgctagttgatttaaatataaaaaatctgactattataagcaatgatacagcttttcctaataaaggaataggaaaacttattgtaaatggtcaagtttctaaagtaattgcttcacatattggaactaatcctgaaactgggaaaaaaatgagctctggtgaacttaaagttgagctttctccacaaggaacactgatcgaaagaattcgtgcagctggatctggactcggaggtgtattaactccaaccggacttgggactatcgttgaagaaggtaagaaaaaagttactatcggtggcaaagaatatctattagaacttcctttatccgctgatgtttcattaataaaaggtagcattgtagatgaatttggaaataccttctatagagctgctactaaaaatttcaatccatatatggcaatggctgcaaaaacagttatagttgaagcagaaaatttagttaaatgtgaagatttaaaaagagatgccataatgactcctggcgtattagtagattatatcgttaaggaggcggcttaattgattgtagataaagttttagcaaaagagataattgccaaaagagttgcaaaagaactaaaaaaaggccaactcgtaaaccttggaataggacttccaactttagtagctaattatgtgccaaaagaaatgaacattactttcgaatcagaaaatggcatggttggcatggcacaaatggcctcatcaggtgaaaatgacccagatataataaatgctggtggggaatatgtaacattattacctcaaggtgcattttttgatagttcaacgtcttttgcactaataagaggaggacatgttgatgttgctgttcttggtgctctagaagttgatgaagaaggtaatttagctaactggattgttccaaataaaattgtcccaggtatgggaggcgccatggatttggcaataggcgcaaaaaaaataatagtggcaatgcaacatacaggaaaaggtaaacctaaaatcgtaaaaaaatgtactctcccacttactgctaaggctcaggtagatttaattgttacagaactttgtgtaattgatgtaacaaatgatggtttacttttcagagaaattcataaagatacaactattgatgaaataaaatttttaacagatgcagatttaattattcccgacaacttaaaaattatggatatctaaatcattctattttaaatatataactttaaaaatcttatgtattaaaaactaagaaaagaggttgattattttatgttagaaagtgaagtatctaaacaaattacaactccacttgctgctccagcgtttcctagaggaccatatagatttcacaatagagaatatctaaacattatttatcgaactgatttagatgctcttcgaaaaatagtaccagagccacttgaattagatggagcatatgttaggtttgagatgatggctatgcctgatacaaccggactaggctcatatactgagtgtggtcaagccattccagtaaaatataatgaggttaaaggtgactacttgcatatgatgtacctagataatgaacctgctattgctgttggaagagaaagcagtgcttatcccaaaaagttcggctatccaaagctatttgttgattcagacgccctagttggcgcccttaagtatggtgcattaccggtagttactgcgacgatgggatataagcatgagcccctagatcttaaagaagcctatactcaaattgcaagacccaatttcatgctaaaaatcattcaaggttatgatggtaagccaagaatttgtgaactcatctgtgcagaaaatactgatataactatccacggtgcttggactggaagtgcacgcctacaattatttagccatgcactagctcctcttgctgatttacctgtattagagatcgtatcagcatctcatatcctaacagatttaactcttggaacacctaaggttgtacatgattatctttcagtaaaataaaagcaatatagaataaccactacaaaagtagtggttattctatattttaaatcaaactgtaaaacttaagttttatagtacctaataatattttactaccagcattagattagttaaaatacaaagtttgtggtaaaagtattttagattgcataatagccttctatacttttaacaatataaccaattgctcaccatctgcttagaatatgcttctttaagctctaaaatacatataaaaaagtaggaatttcttattaaaattcctacttatattatatataaatttaatcgttaggttttattcgcattgttcctctttaatttatctcttataacattttattataattgttcatataattaattcaatatactattatatattttcaagcattaataattattcagcatctgtcattacatatgcttccatactttgacttcttattaaatcatagctaatccatccatagccattgattccccagtctttaccccatgaatttattatttttacagcttttttactatcatcataaccaactacgcaaactgcatgaccacctctattttctccatcaatctggtcataaattggattatcagaatttaaattatcaaaatctggatatactgatattccaataactactggatttccagctgctatttgtgcctttattgcattatagtcaccatctggaagttgactccaactttttgctttatatttggctgcattagccttttgttcatctgtaggtgtaacctcccaactatattcactaccatcataaggcatatcagataatgtagtacaaccttgttcttctaataatttaaatgcat

SEQ ID NO: 101 - protein, 862 aa, Clostridium acetobutylicum
MKVTTVKELDEKLKVIKEAQKKFSCYSQEMVDEIFRNAAMAAIDARIELAKAAVLETGMGLVEDKVIKNHFAGEYIYNKYKDEKTCGIIERNEPYGITKIAEPIGVVAAIIPVTNPTSTTIFKSLISLKTRNGIFFSPHPRAKKSTILAAKTILDAAVKSGAPENIIGWIDEPSIELTQYLMQKADITLATGGPSLVKSAYSSGKPAIGVGPGNTPVIIDESAHIKMAVSSIILSKTYDNGVICASEQSVIVLKSIYNKVKDEFQERGAYIIKKNELDKVREVIFKDGSVNPKIVGQSAYTIAAMAGIKVPKTTRILIGEVTSLGEEEPFAHEKLSPVLAMYEADNFDDALKKAVTLINLGGLGHTSGIYADEIKARDKIDRFSSAMKTVRTFVNIPTSQGASGDLYNFRIPPSFTLGCGFWGGNSVSENVGPKHLLNIKTVAERRENMLWFRVPHKVYFKFGCLQFALKDLKDLKKKRAFIVTDSDPYNLNYVDSIIKILEHLDIDFKVFNKVGREADLKTIKKATEEMSSFMPDTIIALGGTPEMSSAKLMWVLYEHPEVKFEDLAIKFMDIRKRIYTFPKLGKKAMLVAITTSAGSGSEVTPFALVTDNNTGNKYMLADYEMTPNMAIVDAELMMKMPKGLTAYSGIDALVNSIEAYTSVYASEYTNGLALEAIRLIFKYLPEAYKNGRTNEKAREKMAHASTMAGMASANAFLGLCHSMAIKLSSEHNIPSGIANALLIEEVIKFNAVDNPVKQAPCPQYKYPNTIFRYARIADYIKLGGNTDEEKVDLLINKIHELKKALNIPTSIKDAGVLEENFYSSLDRISELALDDQCTGANPRFPLTSEIKEMYINCFKKQP

SEQ ID NO: 102 - DNA, 1665 bp, Clostridium acetobutylicum; identical to SEQ ID NO: 70

SEQ ID NO: 103 - protein, 858 aa, Clostridium acetobutylicum
MKVTNQKELKQKLNELREAQKKFATYTQEQVDKIFKQCAIAAAKERINLAKLAVEETGIGLVEDKIIKNHFAAEYIYNKYKNEKTCGIIDHDDSLGITKVAEPIGIVAAIVPTTNPTSTAIFKSLISLKTRNAIFFSPHPRAKKSTIAAAKLILDAAVKAGAPKNIIGWIDEPSIELSQDLMSEADIILATGGPSMVKAAYSSGKPAIGVGAGNTPAIIDESADIDMAVSSIILSKTYDNGVICASEQSILVMNSIYEKVKEEFVKRGSYILNQNEIAKIKETMFKNGAINADIVGKSAYIIAKMAGIEVPQTTKILIGEVQSVEKSELFSHEKLSPVLAMYKVKDFDEALKKAQRLIELGGSGHTSSLYIDSQNNKDKVKEFGLAMKTSRTFINMPSSQGASGDLYNFAIAPSFTLGCGTWGGNSVSQNVEPKHLLNIKSVAERRENMLWFKVPQKIYFKYGCLRFALKELKDMNKKRAFIVTDKDLFKLGYVNKITKVLDEIDIKYSIFTDIKSDPTIDSVKKGAKEMLNFEPDTIISIGGGSPMDAAKVMHLLYEYPEAEIENLAINFMDIRKRICNFPKLGTKAISVAIPTTAGTGSEATPFAVITNDETGMKYPLTSYELTPNMAIIDTELMLNMPRKLTAATGIDALVHAIEAYVSVMATDYTDELALRAIKMIFKYLPRAYKNGTNDIEAREKMAHASNIAGMAFANAFLGVCHSMAHKLGAMHHVPHGIACAVLIEEVIKYNATDCPTKQTAFPQYKSPNAKRKYAEIAEYLNLKGTSDTEKVTALIEAISKLKIDLSIPQNISAAGINKKDFYNTLDKMSELAFDDQCTTANPRYPLISELKDIYIKSF

SEQ ID NO: 104 - DNA, 2589 bp, Clostridium acetobutylicum
atgaaagtcacaacagtaaaggaattagatgaaaaactcaaggtaattaaagaagctcaaaaaaaattctcttgttactcgcaagaaatggttgatgaaatctttagaaatgcagcaatggcagcaatcgacgcaaggatagagctagcaaaagcagctgttttggaaaccggtatgggcttagttgaagacaaggttataaaaaatcattttgcaggcgaatacatctataacaaatataaggatgaaaaaacctgcggtataattgaacgaaatgaaccctacggaattacaaaaatagcagaacctataggagttgtagctgctataatccctgtaacaaaccccacatcaacaacaatatttaaatccttaatatcccttaaaactagaaatggaattttcttttcgcctcacccaagggcaaaaaaatccacaatactagcagctaaaacaatacttgatgcagccgttaagagtggtgccccggaaaatataataggttggatagatgaaccttcaattgaactaactcaatatttaatgcaaaaagcagatataacccttgcaactggtggtccctcactagttaaatctgcttattcttccggaaaaccagcaataggtgttggtccgggtaacaccccagtaataattgatgaatctgctcatataaaaatggcagtaagttcaattatattatccaaaacctatgataatggtgttatatgtgcttctgaacaatctgtaatagtcttaaaatccatatataacaaggtaaaagatgagttccaagaaagaggagcttatataataaagaaaaacgaattggataaagtccgtgaagtgatttttaaagatggatccgtaaaccctaaaatagtcggacagtcagcttatactatagcagctatggctggcataaaagtacctaaaaccacaagaatattaataggagaagttacctccttaggtgaagaagaaccttttgcccacgaaaaactatctcctgttttggctatgtatgaggctgacaattttgatgatgctttaaaaaaagcagtaactctaataaacttaggaggcctcggccatacctcaggaatatatgcagatgaaataaaagcacgagataaaatagatagatttagtagtgccatgaaaaccgtaagaacctttgtaaatatcccaacctcacaaggtgcaagtggagatctatataattttagaataccaccttctttcacgcttggctgcggattttggggaggaaattctgtttccgagaatgttggtccaaaacatcttttgaatattaaaaccgtagctgaaaggagagaaaacatgctttggtttagagttccacataaagtatattttaagttcggttgtcttcaatttgctttaaaagatttaaaagatctaaagaaaaaaagagcctttatagttactgatagtgacccctataatttaaactatgttgattcaataataaaaatacttgagcacctagatattgattttaaagtatttaataaggttggaagagaagctgatcttaaaaccataaaaaaagcaactgaagaaatgtcctcctttatgccagacactataatagctttaggtggtacccctgaaatgagctctgcaaagctaatgtgggtactatatgaacatccagaagtaaaatttgaagatcttgcaataaaatttatggacataagaaagagaatatatactttcccaaaactcggtaaaaaggctatgttagttgcaattacaacttctgctggttccggttctgaggttactccttttgctttagtaactgacaataacactggaaataagtacatgttagcagattatgaaatgacaccaaatatggcaattgtagatgcagaacttatgatgaaaatgccaaagggattaaccgcttattcaggtatagatgcactagtaaatagtatagaagcatacacatccgtatatgcttcagaatacacaaacggactagcactagaggcaatacgattaatatttaaatatttgcctgaggcttacaaaaacggaagaaccaatgaaaaagcaagagagaaaatggctcacgcttcaactatggcaggtatggcatccgctaatgcatttctaggtctatgtcattccatggcaataaaattaagttcagaacacaatattcctagtggcattgccaatgcattactaatagaagaagtaataaaatttaacgcagttgataatcctgtaaaacaagccccttgcccacaatataagtatccaaacaccatatttagatatgctcgaattgcagattatataaagcttggaggaaatactgatgaggaaaaggtagatctcttaattaacaaaatacatgaactaaaaaaagctttaaatataccaacttcaataaaggatgcaggtgttttggaggaaaacttctattcctcccttgatagaatatctgaacttgcactagatgatcaatgcacaggcgctaatcctagatttcctcttacaagtgagataaaagaaatgtatataaattgttttaaaaaacaaccttaa

SEQ ID NO: 105 - protein, 307 aa, Pseudomonas putida
MSKKLKAAIIGPGNIGTDLVMKMLRSEWIEPVWMVGIDPNSDGLKRARDFGMKTTAEGVDGLLPHVLDDDIRIAFDATSAYVHAENSRKLNALGVLMVDLTPAAIGPYCVPPVNLKQHVGRLEMNVNMVTCGGQATIPMVAAVSRVQPVAYAEIVATVSSRSVGPGTRKNIDEFTRTTAGAIEQVGGAREGKAIIVINPAEPPLMMRDTIHCLTDSEPDQAAITASVHAMIAEVQKYVPGYRLKNGPVFDGNRVSIFMEVEGLGDYLPKYAGNLDIMTAAALRTGEMFAEEIAAGTIQLPRRDIALA

SEQ ID NO: 106 - DNA, 2180 bp, Pseudomonas putida
ggtacccctggagccggtcaaggccggcgacttcatgcgcgtcgagatcggcggcatcggcagcgcctccgtgcgcttcacctgatcgaacagaggacaaacccatgagcaagaaactcaaggcggccatcataggccccggcaatatcggtaccgatctggtgatgaagatgctccgttccgagtggattgagccggtgtggatggtcggcatcgaccccaactccgacggcctcaaacgcgcccgcgatttcggcatgaagaccacagccgaaggcgtcgacggcctgctcccgcacgtgctggacgacgacatccgcatcgccttcgacgccacctcggcctatgtgcatgccgagaatagccgcaagctcaacgcgcttggcgtgctgatggtcgacctgaccccggcggccatcggcccctactgcgtgccgccggtcaacctcaagcagcatgtcggccgcctggaaatgaacgtcaacatggtcacctgcggcggccaggccaccatccccatggtcgccgcggtgtcccgcgtgcagccggtggcctacgccgagatcgtcgccaccgtctcctcgcgctcggtcggcccgggcacgcgcaagaacatcgacgagttcacccgcaccaccgccggcgccatcgagcaggtcggcggcgccagggaaggcaaggcgatcatcgtcatcaacccggccgagccgccgctgatgatgcgcgacaccatccactgcctgaccgacagcgagccggaccaggctgcgatcaccgcttcggttcacgcgatgatcgccgaggtgcagaaatacgtgcccggctaccgcctgaagaacggcccggtgttcgacggcaaccgcgtgtcgatcttcatggaagtcgaaggcctgggcgactacctgcccaagtacgccggcaacctcgacatcatgaccgccgccgcgctgcgtaccggcgagatgttcgccgaggaaatcgccgccggcaccattcaactgccgcgtcgcgacatcgcgctggcttgaggagtagcaccatgaatttgcacggcaagagcgtcatcctgcacgacatgagcctgcgcgacggcatgcacgccaagcgccaccagatcagcctggagcagatggtcgcggtcgccaccggcctcgatcaagccggtatgccgctgatcgagatcacccacggcgacggcctcggcggtcgttcgatcaactacggcttcccggcccacagtgacgaggagtacctgcgcgcggtgatcccgcagctcaagcaggccaaagtctcggcgctgctgctgcccggcatcggcaccgtcgaccacctgaagatggccctggactgcggcgtctcgactattcgcgtggccacccactgtaccgaggcggatgtctccgagcagcacatcggcatggcgcgcaagctgggggtcgacaccgtcggcttcctgatgatggcgcacatgatcagcgccgagaaagtcctggagcaggccaagctgatggaaagctatggtgccaactgcatctactgcaccgactcggccggctacatgctgcctgatgaagtcagcgagaaaatcggcctcctgcgcgccgagctgaacccggccaccgaagtcggcttccacggccaccacaacatgggcatggctatcgccaactcgctggccgccatcgaagccggtgccgcgcgcatcgacggctcggtcgccggcctcggcgccggtgccggcaacaccccgctggaagtgttcgtcgcagtgtgcaaacgcatgggcgtggagaccggcatcgacctgtacaagatcatggacgtggccgaggacctggtggtgccgatgatggatcagccgatccgcgtcgaccgcgacgccctgaccctgggctacgccggggtgtacagctcgttcctgctgttcgcccagcgcgccgagaagaaatatggcgtgtcggcccgcgacatcctggtcgaactgggccggcgcggcaccgtcggtggccaggaagacatgatcgaagacctcgccctggacatggcccgggcccgtcagcagcagaaggtgagcgcatgaaccgtaccctgacccgcgaacaggtgctggccctggccgagcacatcgaaaacgccgagctgaatgtccacgacatcggcaaggtgaccaacgattttcc

SEQ ID NO: 107 - protein, 307 aa, Thermus thermophilus
MSERVKVAILGSGNIGTDLMYKLLKNPGHMELVAVVGIDPKSEGLARARALGLEASHEGIAYILERPEIKIVFDATSAKAHVRHAKLLREAGKIAIDLTPAARGPYVVPPVNLKEHLDKDNVNLITCGGQATIPLVYAVHRVAPVLYAEMVSTVASRSAGPGTRQNIDEFTFTTARGLEAIGGAKKGKAIIILNPAEPPILMTNTVRCIPEDEGFDREAVVASVRAMEREVQAYVPGYRLKADPVFERLPTPWGERTVVSMLLEVEGAGDYLPKYAGNLDIMTASARRVGEVFAQHLLGKPVEEVVA

SEQ ID NO: 108 - DNA, 924 bp, Thermus thermophilus
atgtccgaaagggttaaggtagccatcctgggctccggcaacatcgggacggacctgatgtacaagctcctgaagaacccgggccacatggagcttgtggcggtggtggggatagaccccaagtccgagggcctggcccgggcgcgggccttagggttagaggcgagccacgaagggatcgcctacatcctggagaggccggagatcaagatcgtctttgacgccaccagcgccaaggcccacgtgcgccacgccaagctcctgagggaggcggggaagatcgccatagacctcacgccggcggcccggggcccttacgtggtgcccccggtgaacctgaaggaacacctggacaaggacaacgtgaacctcatcacctgcggggggcaggccaccatccccctggtctacgcggtgcaccgggtggcccccgtgctctacgcggagatggtctccacggtggcctcccgctccgcgggccccggcacccggcagaacatcgacgagttcaccttcaccaccgcccggggcctggaggccatcgggggggccaagaaggggaaggccatcatcatcctgaacccggcggaaccccccatcctcatgaccaacaccgtgcgctgcatccccgaggacgagggctttgaccgggaggccgtggtggcgagcgtccgggccatggagcgggaggtccaggcctacgtgcccggctaccgcctgaaggcggacccggtgtttgagaggcttcccaccccctggggggagcgcaccgtggtctccatgctcctggaggtggagggggcgggggactatttgcccaaatacgccggcaacctggacatcatgacggcttctgcccggagggtgggggaggtcttcgcccagcacctcctggggaagcccgtggaggaggtggtggcgtga

SEQ ID NO: 109 - protein, 417 aa, Escherichia coli
MTFSLFGDKFTRHSGITLLMEDLNDGLRTPGAIMLGGGNPAQIPEMQDYFQTLLTDMLESGKATDALCNYDGPQGKTELLTLLAGMLREKLGWDIEPQNIALTNGSQSAFFYLFNLFAGRRADGRVKKVLFPLAPEYIGYADAGLEEDLFVSARPNIELLPEGQFKYHVDFEHLHIGEETGMICVSRPTNPTGNVITDEELLKLDALANQHGIPLVIDNAYGVPFPGIIFSEARPLWNPNIVLCMSLSKLGLPGSRCGIIIANEKIITAITNMNGIISLAPGGIGPAMMCEMIKRNDLLRLSETVIKPFYYQRVQETIAIIRRYLPENRCLIHKPEGAIFLWLWFKDLPITTKQLYQRLKARGVLMVPGHNFFPGLDKPWPHTHQCMRMNYVPEPEKIEAGVKILAEEIERAWAESH

SEQ ID NO: 110 - protein, 417 aa, Escherichia coli; identical to SEQ ID NO: 109

SEQ ID NO: 111 - protein, 425 aa, Bacillus licheniformis
MKPPLSKIGEKMIEKTGVRAVMSDIQEVLAGGERSYINLSAGNPMILPGVSAMWKSALADLLDDDRFSSVIGQYGSSYGTDELIASVVRFFSERYSAGIRKENVLITAGSQQLFFLAINSFCGMGSGSVMKKALIPMLPDYSGYSGAALEREMIEGIPPLISKLDDHTFRYELDRKGFLERMRIGAVLLSRPNNPCGNILPKEDVAFISDACREANVPLFIDSAYAPPFPAIHFIDMEPIFNEQIIHCMSLSKAGLPGERIGIAIGPSRYIQAMEAFQSNAAIHSSRLGQYMAASVLNDGRLADVSLNEVRPYYRNKFMLLKETLLCKMPEDIKWYLHQGEGSLFGWLWFEDLPVTDAALYEYMKADGVIIVPGSSFFHRQSRRLAHSHQCIRISLTAADEDIIRGIDVLAKIAKGVYEKQVEYL

SEQ ID NO: 112 - DNA, 1278 bp, Bacillus licheniformis
ttataagtattcaacctgtttctcatatacacccttcgcaattttagctaaaacatcgattccccttataatatcttcatccgccgcggttaggctgattcgtatacactggtgtgaatgcgccaggcgccgggattgacggtgaaagaaagatgatccgggaacgataatgactccatccgctttcatatactcatacagcgctgcatcggtcaccggcaggtcttcaaaccacagccatccgaaaagcgatccttccccttgatgcagataccatttgatgtcttcaggcatcttgcataaaagcgtttccttgagcagcatgaatttattgcggtaatatggcctgacttcattcagcgacacgtcggcgaggcgcccgtcattcaatactgatgcagccatatactgccccagccttgaagaatggatcgccgcattcgactgaaaagcttccattgcctgaatataccgggacggcccgatggcgattccgatcctttcgccaggcaggccggcttttgaaaggctcatacagtgaatgatctgctcgttgaaaatcggttccatgtcgataaagtgaatcgccggaaaaggcggagcatatgcggaatcaatgaacagcggaacattcgcttctcggcatgcgtctgaaatgaatgctacatcttctttaggcaagatgtttccgcaaggattgttcgggcgcgatagcaagacagcaccgatgcgcatcctctctaaaaaccccttacggtcgagctcatatcgaaacgtatgatcatccaatttcgatatgagcggagggatcccctcaatcatctcccgctccagtgccgccccgctgtatcccgaatagtcaggcagcatcgggatcaaggcttttttcatcacagatccgcttcccattccgcaaaacgaattgatcgccagaaaaaacagctgctggcttccggctgtaatcaacacgttctcttttcgaatgccggcgctataccgctctgaaaagaagcggacaacacttgcaatcagttcatcggttccatagctcgatccgtattggccgatcaccgaagaaaacctgtcatcgtcaaggagatcggcaagagccgacttccacatggctgacacgccgggcaaaatcatcggattgcccgcacttaaattaatgtatgaccgttcaccgccggccaggacttcctgaatatcgctcatcacagccctgacccctgttttctcaatcattttctctccgattttgcttaatggcggcttcac

SEQ ID NO: 113 - protein, 309 aa, Escherichia coli
MTTKKADYIWFNGEMVRWEDAKVHVMSHALHYGTSVFEGIRCYDSHKGPVVFRHREHMQRLHDSAKIYRFPVSQSIDELMEACRDVIRKNNLTSAYIRPLIFVGDVGMGVNPPAGYSTDVIIAAFPWGAYLGAEALEQGIDAMVSSWNRAAPNTIPTAAKAGGNYLSSLLVGSEARRHGYQEGIALDVNGYISEGAGENLFEVKDGVLFTPPFTSSALPGITRDAIIKLAKELGIEVREQVLSRESLYLADEVFMSGTAAEITPVRSVDGIQVGEGRCGPVTKRIQQAFFGLFTGETEDKWGWLDQVNQ

SEQ ID NO: 114 - DNA, 1476 bp, Escherichia coli; identical to SEQ ID NO: 46

SEQ ID NO: 115 - protein, 376 aa, Saccharomyces cerevisiae
MTLAPLDASKVKITTTQHASKPKPNSELVFGKSFTDHMLTAEWTAEKGWGTPEIKPYQNLSLDPSAVVFHYAFELFEGMKAYRTVDNKITMFRPDMNMKRMNKSAQRICLPTFDPEELITLIGKLIQQDKCLVPEGKGYSLYIRPTLIGTTAGLGVSTPDRALLYVICCPVGPYYKTGFKAVRLEATDYATRAWPGGCGDKKLGANYAPCVLPQLQAASRGYQQNLWLFGPNNNITEVGTMNAFFVFKDSKTGKKELVTAPLDGTILEGVTRDSILNLAKERLEPSEWTISERYFTIGEVTERSKNGELLEAFGSGTAAIVSPIKEIGWKGEQINIPLLPGEQTGPLAKEVAQWINGIQYGETEHGNWSRVVTDLN

SEQ ID NO: 116 - protein, 376 aa, Saccharomyces cerevisiae; identical to SEQ ID NO: 115

SEQ ID NO: 117 - protein, 330 aa, Methanobacterium thermoautotrophicum
MRLWRALYRPPTITYPSKSPEVIIMSCEASGKIWLNGEMVEWEEATVHVLSHVVHYGSSVFEGIRCYRNSKGSAIFRLREHVKRLFDSAKIYRMDIPYTQEQICDAIVETVRENGLEECYIRPVVFRGYGEMGVHPVNCPVDVAVAAWEWGAYLGAEALEVGVDAGVSTWRRMAPNTMPNMAKAGGNYLNSQLAKMEAVRHGYDEAIMLDYHGYISEGSGENIFLVSEGEIYTPPVSSSLLRGITRDSVIKIARTEGVTVHEEPITREMLYIADEAFFTGTAAEITPIRSVDGIEIGAGRRGPVTKLLQDEFFRIIRAETEDSFGWLTYI

SEQ ID NO: 118 - DNA, 993 bp, Methanobacterium thermoautotrophicum
tcagatgtaggtgagccatccgaagctgtcctctgtctctgccctgattatcctgaagaactcatcctgcagcagctttgtaacgggaccccttcgcccggcacctatctctataccatcaactgatctgatgggtgttatctctgcggctgtacctgtgaagaaggcctcatctgcgatgtagagcatctccctggttatgggttcctcatgcacggtaacaccctcggtcctggctatctttattacggagtcccttgttatccccctcagaagggatgatgaaacagggggggtgtaaatttcaccctcactgacgaggaatatgttctccccgctaccctcacttatgtagccatggtagtccagcattatggcctcatcatagccgtgtctcacagcctccatcttggcaagctgtgagttgaggtagttaccgccggcctttgccatgttgggcattgtgtttggtgccatcctccgccaggttgaaacaccagcatcgacaccaacctcaagggcctctgcacccagataggccccccattcccaggcagccacagcgacgtccactgggcagttcaccgggtgaacacccatctcaccgtatcccctgaataccacgggtcttatatagcactcctcaagtccgttctccctgacggtctcaactatggcatcacatatctgctcctgggtgtagggtatgtccatccggtatatctttgcagaatcaaaaaggcgtttaacatgctcccgcaaacggaagatggctgaccccttactgttcctgtagcaccttattccctcaaagacagatgatccataatgcacaacatgtgagagtacgtggacggtggcttcttcccattcaaccatttcaccgtttaaccatatctttccactggcttcgcatgacatgataataacctcaggtgatttactaggataggttatggttggaggcctatataatgctctccataaccgcaa

SEQ ID NO: 119 - protein, 364 aa, Streptomyces coelicolor
MTDVNGAPADVLHTLFHSDQGGHEQVVLCQDRASGLKAVIALHSTALGPALGGTRFYPYASEAEAVADALNLARGMSYKNAMAGLDHGGGKAVIIGDPEQIKSEELLLAYGRFVASLGGRYVTACDVGTYVADMDVVARECRWTTGRSPENGGAGDSSVLTSFGVYQGMRAAAQHLWGDPTLRDRTVGIAGVGKVGHHLVEHLLAEGAHVVVTDVRKDVVRGITERHPSVVAVADTDALIRVENLDIYAPCALGGALNDDTVPVLTAKVVCGAANNQLAHPGVEKDLADRGILYAPDYVVNAGGVIQVADELHGFDFDRCKAKASKIYDTTLAIFARAKEDGIPPAAAADRIAEQRMAEARPRP

SEQ ID NO: 120 - DNA, 1095 bp, Streptomyces coelicolor
tcacggccggggacgggcctccgccatccgctgctcggcgatccggtcggccgccgcggccggcggaataccgtcctccttcgcacgtgcgaatatggccagcgtggtgtcgtagatcttcgaggccttcgccttgcaccggtcgaagtcgaacccgtgcagctcgtcggcgacctggatgacaccgccggcgttcaccacatagtccggcgcgtagaggatcccgcggtcggcgaggtccttctcgacgcccgggtgggcgagctggttgttggccgcgccgcacaccaccttggcggtcagcaccggcacggtgtcgtcgttcagcgcgccgccgagcgcgcagggcgcgtagatgtccaggttctccacccggatcagcgcgtcggtgtcggcgacggcgaccaccgacgggtgccgctccgtgatcccgcgcaccacgtccttgcgcacgtccgtgacgacgacgtgggcgccctcggcgagcaggtgctcgaccaggtggtggccgaccttgccgacgcccgcgatgccgacggtgcggtcgcgcagcgtcgggtcgccccacaggtgctgggcggcggcccgcatgccctggtagacgccgaaggaggtgagcacggaggagtcgcccgcgccgccgttctccggggaacgcccggtcgtccagcggcactcgcgggccacgacgtccatgtcggcgacgtaggtgccgacgtcgcacgcggtgacgtagcggccgcccagcgaggcgacgaaccggccgtaggcgaggagcagctcctcgctcttgatctgctccggatcgccgatgatcacggccttgccgccaccgtggtccagaccggccatggcgttcttgtacgacatcccgcgggcgaggttcagcgcgtcggcgacggcctccgcctcgctcgcgtacgggtagaagcgggtaccgccgagcgccgggcccagggcggtggagtggagggcgatcacggccttgaggccgctggcacggtcctggcagagcacgacttgctcatgtcccccctgatccgagtggaacagggtgtgcagtacatcagcaggtgcgccgtttacgtcggtcac

SEQ ID NO: 121 - protein, 364 aa, Bacillus subtilis
MELFKYMEKYDYEQLVFCQDEQSGLKAIIAIHDTTLGPALGGTRMWTYENEEAAIEDALRLARGMTYKNAAAGLNLGGGKTVIIGDPRKDKNEEMFRAFGRYIQGLNGRYITAEDVGTTVEDMDIIHDETDYVTGISPAFGSSGNPSPVTAYGVYRGMKAAAKAAFGTDSLEGKTIAVQGVGNVAYNLCRHLHEEGANLIVTDINKQSVQRAVEDFGARAVDPDDIYSQDCDIYAPCALGATINDDTIKQLKAKVIAGAANNQLKETRHGDQIHEMGIVYAPDYVINAGGVINVADELYGYNAERALKKVEGIYGNIERVLEISQRDGIPAYLAADRLAEERIERMRRSRSQFLQNGHSVLSRR

SEQ ID NO: 122 - protein, 364 aa, Bacillus subtilis; identical to SEQ ID NO: 121

SEQ ID NO: 123 - protein, 594 aa, Streptomyces viridifaciens
MSTSSASSGPDLPFGPEDTPWQKAFSRLRAVDGVPRVTAPSSDPREVYMDIPEIPFSKVQIPPDGMDEQQYAEAESLFRRYVDAQTRNFAGYQVTSDLDYQHLSHYLNRHLNNVGDPYESSSYTLNSKVLERAVLDYFASLWNAKWPHDASDPETYWGYVLTMGSSEGNLYGLWNARDYLSGKLLRRQHREAGGDKASVVYTQALRHEGQSPHAYEPVAFFSQDTHYSLTKAVRVLGIDTFHSIGSSRYPDENPLGPGTPWPTEVPSVDGAIDVDKLASLVRFFASKGYPILVSLNYGSTFKGAYDDVPAVAQAVRDICTEYGLDRRRVYHDRSKDSDFDERSGFWIHIDAALGAGYAPYLQMARDAGMVEEAPPVFDFRLPEVHSLTMSGHKWMGTPWACGVYMTRTGLQMTPPKSSEYIGAADTTFAGSRNGFSSLLLWDYLSRHSYDDLVRLAADCDRLAGYAHDRLLTLQDKLGMDLWVARSPQSLTVRFRQPCADIVRKYSLSCETVYEDNEQRTYVHLYAVPHLTRELVDELVRDLRQPGAFTNAGALEGEAWAGVIDALGRPDPDGTYAGALSAPASGPRSEDGGGS

SEQ ID NO: 124 - DNA, 1785 bp, Streptomyces viridifaciens
gtgtcaacttcctccgcttcttccgggccggacctccccttcgggcccgaggacacgccatggcagaaggccttcagcaggctgcgggcggtggatggcgtgccgcgcgtcaccgcgccgtccagtgatccgcgtgaggtctacatggacatcccggagatccccttctccaaggtccagatccccccggacggaatggacgagcagcagtacgcagaggccgagagcctcttccgccgctacgtagacgcccagacccgcaacttcgcgggataccaggtcaccagcgacctcgactaccagcacctcagtcactatctcaaccggcatctgaacaacgtcggcgatccctatgagtccagctcctacacgctgaactccaaggtccttgagcgagccgttctcgactacttcgcctccctgtggaacgccaagtggccccatgacgcaagcgatccggaaacgtactggggttacgtgctgaccatgggctccagcgaaggcaacctgtacgggttgtggaacgcacgggactatctgtcgggcaagctgctgcggcgccagcaccgggaggccggcggcgacaaggcctcggtcgtctacacgcaagcgctgcgacacgaagggcagagtccgcatgcctacgagccggtggcgttcttctcgcaggacacgcactactcgctcacgaaggccgtgcgggttctgggcatcgacaccttccacagcatcggcagcagtcggtatccggacgagaacccgctgggccccggcactccgtggccgaccgaagtgccctcggttgacggtgccatcgatgtcgacaaactcgcctcgttggtccgcttcttcgccagcaagggctacccgatactggtcagcctcaactacgggtcaacgttcaagggcgcctacgacgacgtcccggccgtggcacaggccgtgcgggacatctgcacggaatacggtctggatcggcggcgggtataccacgaccgcagtaaggacagtgacttcgacgagcgcagcggcttctggatccacatcgatgccgccctgggggcgggctacgctccctacctgcagatggcccgggatgccggcatggtcgaggaggcgccgcccgttttcgacttccggctcccggaggtgcactcgctgaccatgagcggccacaagtggatgggaacaccgtgggcatgcggtgtctacatgacacggaccgggctgcagatgaccccgccgaagtcgtccgagtacatcggggcggccgacaccaccttcgcgggctcccgcaacggcttctcgtcactgctgctgtgggactacctgtcccggcattcgtatgacgatctggtgcgcctggccgccgactgcgaccggctggccggctacgcccacgaccggttgctgaccttgcaggacaaactcggcatggatctgtgggtcgcccgcagcccgcagtccctcacggtgcgcttccgtcagccatgtgcagacatcgtccgcaagtactcgctgtcgtgtgagacggtctacgaagacaacgagcaacggacctacgtacatctctacgccgttccccacctcactcgggaactcgtggatgagctcgtgcgcgatctgcgccagcccggagccttcaccaacgctggtgcactggagggggaggcctgggccggggtgatcgatgccctcggccgcccggaccccgacggaacctatgccggcgccttgagcgctccggcttccggcccccgctccgaggacggcggcgggagctga

SEQ ID NO: 125 - protein, 440 aa, Alcaligenes denitrificans
MSAAKLPDLSHLWMPFTANRQFKANPRLLASAKGMYYTSFDGRQILDGTAGLWCVNAGHCREEIVSAIASQAGVMDYAPGFQLGHPLAFEAATAVAGLMPQGLDRVFFTNSGSESVDTALKIALAYHRARGEAQRTRLIGRERGYHGVGFGGISVGGISPNRKTFSGALLPAVDHLPHTHSLEHNAFTRGQPEWGAHLADELERIIALHDASTIAAVIVEPMAGSTGVLVPPKGYLEKLREITARHGILLIFDEVITAYGRLGEATAAAYFGVTPDLITMAKGVSNAAVPAGAVAVRREVHDAIVNGPQGGIEFFHGYTYSAHPLAAAAVLATLDIYRREDLFARARKLSAAFEEAAHSLKGAPHVIDVRNIGLVAGIELSPREGAPGARAAEAFQKCFDTGLMVRYTGDILAVSPPLIVDENQIGQIFEGIGKVLKEVA

SEQ ID NO: 126 - DNA, 1947 bp, Alcaligenes denitrificans
ttcgatggcgcgctgcacggcggccaccagctgctccaccaggggtgggcgcctgcccgcgcgcgcggtcgggctggaaatcgatcatggatgaatctatacagttgtcatgattgcaactatacagttagcccgttttgcggcaattgtatattttcattcgctcgtggacgtccgagaatcggtttgatcgcgccgcccgcccctttccgcgcagcggcgtttcttttcctccggagtctccccatgagcgctgccaaactgcccgacctgtcccacctctggatgccctttaccgccaaccggcagttcaaggcgaacccccgcctgctggcctcggccaagggcatgtactacacgtctttcgacggccgccagatcctggacggcacggccggcctgtggtgcgtgaacgccggccactgccgcgaagaaatcgtctccgccatcgccagccaggccggcgtcatggactacgcgccggggttccagctcggccacccgctggccttcgaggccgccaccgccgtggccggcctgatgccgcagggcctggaccgcgtgttcttcaccaattcgggctccgaatcggtggacaccgcgctgaagatcgccctggcctaccaccgcgcgcgcggcgaggcgcagcgcacccgcctcatcgggcgcgagcgcggctaccacggcgtgggcttcggcggcatttccgtgggcggcatctcgcccaaccgcaagaccttctccggcgcgctgctgccggccgtggaccacctgccgcacacccacagcctggaacacaacgccttcacgcgcggccagcccgagtggggcgcgcacctggccgacgagttggaacgcatcatcgccctgcacgacgcctccaccatcgcggccgtgatcgtcgagcccatggccggctccaccggcgtgctcgtcccgcccaagggctatctcgaaaaactgcgcgaaatcaccgcccgccacggcattctgctgatcttcgacgaagtcatcaccgcgtacggccgcctgggcgaggccaccgccgcggcctatttcggcgtaacgcccgacctcatcaccatggccaagggcgtgagcaacgccgccgttccggccggcgccgtcgcggtgcgccgcgaagtgcatgacgccatcgtcaacggaccgcaaggcggcatcgagttcttccacggctacacctactcggcccacccgctggccgccgccgccgtgctcgccacgctggacatctaccgccgcgaagacctgttcgcccgcgcccgcaagctgtcggccgcgttcgaggaagccgcccacagcctcaagggcgcgccgcacgtcatcgacgtgcgcaacatcggcctggtggccggcatcgagctgtcgccgcgcgaaggcgccccgggcgcgcgcgccgccgaagccttccagaaatgcttcgacaccggcctcatggtgcgctacacgggcgacatcctcgcggtgtcgcctccgctcatcgtcgacgaaaaccagatcggccagatcttcgagggcatcggcaaggtgctcaaggaagtggcttagggtgaacacgccctgagccggccccggcaggaaacgcgccgccgcgcggcggcgcgtccatcgaactcccgcatcgagcttttgcattcatgaagaaaatcacgcatttcatcaacggccagccccacgaaggccgcagcaaccgctacaccgagggcttcaacccggccacgggcgagtcgtctcctcgatctgcctgggcggggccgaagaagtggacctggccgtggcggccgcccgcgcggcctttcccgcctggtccgaaacgccggcgctcaagcgcgcgcgcgtgctgttcaacttcaaggcgctgctggacaagcaccaggacgagctggccgcgctcatcacgcgcgagcacggcaaggtgttttccga

SEQ ID NO: 127 - protein, 443 aa, Ralstonia eutropha
MDAAKTVIPDLDALWMPFTANRQYKAAPRLLASASGMYYTTHDGRQILDGCAGLWCVAAGHCRKEIAEAVARQAATLDYAPPFQMGHPLSFEAATKVAAIMPQGLDRIFFTNSGSESVDTALKIALAYHRARGEGQRTRFIGRERGYHGVGFGGMAVGGIGPNRKAFSANLMPGTDHLPATLNIAEAAFSKGQPTWGAHLADELERIVALHDPSTIAAVIVEPLAGSAGVLVPPVGYLDKLREITTKHGILLIFDEVITAFGRLGTATAAERFKVTPDLITMAKAINNAAVPMGAVAVRREVHDTVVNSAAPGAIELAHGYTYSGHPLAAAAAIATLDLYQRENLFGRAAELSPVFEAAVHSVRSAPHVKDIRNLGMVAGIELEPRPGQPGARAYEAFLKCLERGVLVRYTGDILAFSPPLIISEAQIAELFDTVKQALQEVQ

SEQ ID NO: 128 - DNA, 1341 bp, Ralstonia eutropha
atggccgactcacccaacaacctcgctcacgaacatccttcacttgaacactattggatgccttttaccgccaatcgccaattcaaagcgagccctcgtttactcgcccaagctgaaggtatgtattacacagatatcaatggcaacaaggtattagactctacagcgggcttatggtgttgtaatgctggccatggtcgccgtgagatcagtgaagccgtcagcaaacaaattcggcagatggattacgctccctccttccaaatgggccatcccatcgcttttgaactggccgaacgtttaaccgaactcagcccagaaggactcaacaaagtattctttaccaactcaggctctgagtcggttgataccgcgctaaaaatggctctttgctaccatagagccaatggccaagcgtcacgcacccgctttattggccgtgaaatgggttaccatggcgtaggatttggtgggatctcggtgggtggtttaagcaataaccgtaaagccttcagcggccagctattgcaaggcgtggatcacctgccccacaccttagacattcaacatgccgcctttagtcgtggcttaccgagcctcggtgctgaaaaagctgaggtattagaacaattagtcacactccatggcgccgaaaatattgccgccgttattgttgaacccatgtcaggttctgcaggggtaattttaccacctcaaggctacttaaaacgcttacgtgaaatcactaaaaaacacggcatcttattgattttcgatgaagtcattaccgcatttggccgtgtaggtgcagcattcgccagccaacgttggggcgttattccagacataatcaccacggctaaagccattaataatggcgccatccccatgggcgcagtgtttgtacaggattatatccacgatacttgcatgcaagggccaaccgaactgattgaatttttccacggttatacctattcgggccacccagtcgccgcagcagcagcactcgccacgctctccatctaccaaaacgagcaactgtttgagcgcagttttgagcttgagcggtatttcgaagaagccgttcatagcctcaaagggttaccgaatgtgattgatattcgcaacaccggattagtcgcgggtttccagctagcaccgaatagccaaggtgttggtaaacgcggatacagcgtgttcgagcattgtttccatcaaggcacactcgtgcgggcaacgggcgatattatcgccatgtccccaccactcattgttgagaaacatcagattgaccaaatggtaaatagccttagcgatgcaattcacgccgttggatga

SEQ ID NO: 129 - protein, 446 aa, Shewanella oneidensis
MADSPNNLAHEHPSLEHYWMPFTANRQFKASPRLLAQAEGMYYTDINGNKVLDSTAGLWCCNAGHGRREISEAVSKQIRQMDYAPSFQMGHPIAFELAERLTELSPEGLNKVFFTNSGSESVDTALKMALCYHRANGQASRTRFIGREMGYHGVGFGGISVGGLSNNRKAFSGQLLQGVDHLPHTLDIQHAAFSRGLPSLGAEKAEVLEQLVTLHGAENIAAVIVEPMSGSAGVILPPQGYLKRLREITKKHGILLIFDEVITAFGRVGAAFASQRWGVIPDIITTAKAINNGAIPMGAVFVQDYIHDTCMQGPTELIEFFHGYTYSGHPVAAAAALATLSIYQNEQLFERSFELERYFEEAVHSLKGLPNVIDIRNTGLVAGFQLAPNSQGVGKRGYSVFEHCFHQGTLVRATGDIIAMSPPLIVEKHQIDQMVNSLSDAIHAVG

SEQ ID NO: 130 - DNA, 1341 bp, Shewanella oneidensis; identical to SEQ ID NO: 128

SEQ ID NO: 131 - protein, 448 aa, Pseudomonas putida
MNMPETGPAGIASQLKLDAHWMPYTANRNFQRDPRLIVAAEGNYLVDDHGRKIFDALSGLWTCGAGHTRKEIADAVTRQLSTLDYSPAFQFGHPLSFQLAEKIAELVPGNLNHVFYTNSGSECADTALKMVRAYWRLKGQATKTKIIGRARGYHGVNIAGTSLGGVNGNRKMFGQLLDVDHLPHTVLPVNAFSKGLPEEGGIALADEMLKLIELHDASNIAAVIVEPLAGSAGVLPPPKGYLKRLREICTQHNILLIFDEVITGFGRMGAMTGSEAFGVTPDLMCIAKQVTNGAIPMGAVIASSEIYQTFMNQPTPEYAVEFPHGYTYSAHPVACAAGLAALDLLQKENLVQSAAELAPHFEKLLHGVKGTKNIVDIRNYGLAGAIQIAARDGDAIVRPYEAAMKLWKAGFYVRFGGDTLQFGPTFNTKPQELDRLFDAVGETLNLID

SEQ ID NO: 132 - DNA, 930 bp, Pseudomonas putida
atgaccacgaagaaagctgattacatttggttcaatggggagatggttcgctgggaagacgcgaaggtgcatgtgatgtcgcacgcgctgcactatggcacttcggtttttgaaggcatccgttgctacgactcgcacaaaggaccggttgtattccgccatcgtgagcatatgcagcgtctgcatgactccgccaaaatctatcgcttcccggtttcgcagagcattgatgagctgatggaagcttgtcgtgacgtgatccgcaaaaacaatctcaccagcgcctatatccgtccgctgatcttcgtcggtgatgttggcatgggagtaaacccgccagcgggatactcaaccgacgtgattatcgctgctttcccgtggggagcgtatctgggcgcagaagcgctggagcaggggatcgatgcgatggtttcctcctggaaccgcgcagcaccaaacaccatcccgacggcggcaaaagccggtggtaactacctctcttccctgctggtgggtagcgaagcgcgccgccacggttatcaggaaggtatcgcgctggatgtgaacggttatatctctgaaggcgcaggcgaaaacctgtttgaagtgaaagatggtgtgctgttcaccccaccgttcacctcctccgcgctgccgggtattacccgtgatgccatcatcaaactggcgaaagagctgggaattgaagtacgtgagcaggtgctgtcgcgcgaatccctgtacctggcggatgaagtgtttatgtccggtacggcggcagaaatcacgccagtgcgcagcgtagacggtattcaggttggcgaaggccgttgtggcccggttaccaaacgcattcagcaagccttcttcggcctcttcactggcgaaaccgaagataaatggggctggttagatcaagttaatcaataa

SEQ ID NO: 133 - protein, 566 aa, Streptomyces cinnamonensis
MDADAIEEGRRRWQARYDKARKRDADFTTLSGDPVDPVYGPRPGDTYDGFERIGWPGEYPFTRGLYATGYRGRTWTIRQFAGFGNAEQTNERYKMILANGGGGLSVAFDMPTLMGRDSDDPRSLGEVGHCGVAIDSAADMEVLFKDIPLGDVTTSMTISGPAVPVFCMYLVAAERQGVDPAVLNGTLQTDIFKEYIAQKEWLFQPEPHLRLIGDLMEHCARDIPAYKPLSVSGYHIREAGATAAQELAYTLADGFGYVELGLSRGLDVDVFAPGLSFFFDAHVDFFEEIAKFRAARRIWARWLRDEYGAKTEKAQWLRFHTQTAGVSLTAQQPYNNVVRTAVEALAAVLGGTNSLHTNALDETLALPSEQAAEIALRTQQVLMEETGVANVADPLGGSWYIEQLTDRIEADAEKIFEQIRERGRRACPDGQHPIGPITSGILRGIEDGWFTGEIAESAFQYQRSLEKGDKRVVGVNCLEGSVTGDLEILRVSHEVEREQVRELAGRKGRRDDARVRASLDAMLAAARDGSNMIAPMLEAVRAEATLGEICGVLRDEWGVYVEPPGF

SEQ ID NO: 134 - DNA, 4362 bp, Streptomyces cinnamonensis
tgaggcgctggatcgcctcggagagcagctggtaacggtccgcgtggtactcggccggggtgcagccgtccacgatgtgcgggatcgcgtcgggctcgaggatcaccagggcgggggcgtcgccgatcgcgtcggcgaacgtgtccacccagctccggtaggcctccgcactggccgcgccgcccgcggagtgctgaccgcagtcgcggtgcgggatgttgtacgcgacgagtacggcggtgcggtcctccttgaccgcgccccgcgtcgccttcgcgacgtcgggcgccggatcgtccccggccggccacacggccatggcccgttcggagatgcgcctgagcgtctcggcgtcctcggcgcggccctgttcctcccactgcctgacctggcgcgcggcggggctgtcggggtcgacccagaaggtgccggcggggggcccggcgctcgcggtggcgggcttgcgcacggccgcctcctccttcgtgccgtcggaccccgggtctgaggaggagcagcctgccgggagcccgagggcggcgagggccgcgagtgccgtgaacgtgcggagcagccggtgcatccagcccccttgggcgatggtgacagtgacggtcagtcagcccggcaatcgttacataaaggactattcaagctcttgtgccacaccgcctccggtgccgagcgcgaacccggcgggcaccagagccccgccgcggccgcggagccgtacgtacgaccgaattgcgagacggggctgaccaccatatgaccggcgggtaaggtcgatgccgtgccgaagccgctcagcctccccttcgatcccatcgcccgcgccgacgagctctggaagcagcgctggggatcggtcccggccatgggcgcgatcacctcgatcatgcgggcgcaccagatcctgctcgccgaggtcgacgcggtcgtcaagccgtacggactgaccttcgcgcgctacgaggcgctggtgctcctcaccttctcgcaggccggcgagttgccgatgtcgaagatcggcgagcggctcatggtgcacccgacctcggtcacgaacaccgtggaccgcctggtgaagtccggcctggtcgacaagcgcccgaaccccaacgacggccgcggcacgctcgcctccatcacggagaagggccgcgaggtcgtcgaggcggccacccgcgagctgatggcgatggacttcgggctcggggtgtacgacgcggaggagtgcggggagatcttcgcgatgctgcggcccctgcgggtggcggcgcgcgatttcgaggagcagtagggcccgcccggtgagaagtgggatcgggtcgtcccggtacgggcgggggcggcgaagatcgcgtgaaaagggcggttacgctcgtagccatgaaacgcagcgtgctgacccgctaccgggtgatggcctacgtcaccgccgtcatgctcctcatcctgtgcgcctgcatggtggccaagtacggcttcgacaagggcgagggtctgaccctcgtcgtgtcgcaggtgcacggcgtgctctacatcatctacctgatcttcgccttcgacctgggctccaaggcgaagtggccgttcggcaagctgctctgggtgctggtctcgggcacgatcccgaccgccgccttcttcgtcgagcgcaaggtcgcccgtgacgtcgagccgctgatcgccgacggctccccggtcaccgcgaaggcgtaacccgcaccgccacggacaggtccgtggcggttggccatcgacttttactaggacgtcctagtaaattcgatggtatggacgctgacgcgatcgaggaaggccgccgacgctggcaggcccgttacgacaaggcccgcaagcgcgacgcggacttcaccacgctctccggggaccccgtcgaccccgtctacggcccccggcccggggacacgtacgacgggttcgagcggatcggctggccgggggagtaccccttcacccgcgggctctacgccaccgggtaccgcggccgcacctggaccatccgccagttcgccggcttcggcaacgccgagcagacgaacgagcgctacaagatgatcctggccaacggcggcggcggcctctccgtcgccttcgacatgccgaccctcatgggccgcgactccgacgacccgcgctcgctcggcgaggtcggccactgcggtgtcgccatcgactccgccgccgacatggaggtcctcttcaaggacatcccgctcggcgacgtcacgacgtccatgaccatcagcgggcccgccgtgcccgtcttctgcatgtacctcgtcgcggccgagcgccagggcgtcgacccggccgtcctcaacggcacgctgcagaccgacatcttcaaggagtacatcgcccagaaggagtggctcttccagcccgagccgcacctgcgcctcatcggcgacctgatggagcactgcgcgcgcgacatccccgcgtacaagccgctctcggtctccggctaccacatccgcgaggccggggcgacggccgcgcaggagctcgcgtacaccctcgcggacggcttcgggtacgtggaactgggcctctcgcgcggcctggacgtggacgtcttcgcgcccggcctctccttcttcttcgacgcgcacgtcgacttcttcgaggagatcgcgaagttccgcgccgcacgccgcatctgggcgcgctggctccgggacgagtacggagcgaagaccgagaaggcacagtggctgcgcttccacacgcagaccgcgggggtctcgctcacggcccagcagccgtacaacaacgtggtgcggacggcggtggaggccctcgccgcggtgctcggcggcacgaactccctgcacaccaacgctctcgacgagacccttgccctccccagcgagcaggccgcggagatcgcgctgcgcacccagcaggtgctgatggaggagaccggcgtcgccaacgtcgcggacccgctgggcggctcctggtacatcgagcagctcaccgaccgcatcgaggccgacgccgagaagatcttcgagcagatcagggagcgggggcggcgggcctgccccgacgggcagcacccgatcgggccgatcacctccggcatcctgcgcggcatcgaggacggctggttcaccggcgagatcgccgagtccgccttccagtaccagcggtccctggagaagggcgacaagcgggtcgtcggcgtcaactgcctcgaaggctccgtcaccggcgacctggagatcctgcgcgtcagccacgaggtcgagcgcgagcaggtgcgggagcttgcggggcgcaaggggcggcgtgacgatgcgcgggtgcgggcctcgctcgacgcgatgctcgccgctgcgcgggacgggtcgaacatgattgcccccatgctggaggcggtgcgggccgaggcgaccctcggggagatctgcggggtgcttcgcgatgagtggggggtctacgtggagccgcccgggttctgagggcgcgctccctttgcctgcgggtctgctgtggctggtcgcgcagttccccgcacccctgaaagaccccggcgctttcccttcctggctcgcctcgtcgctgtctgcggggccgtgggggctggtcgcgcagttccccgcgcccctgcccgcacctgcgccccgccgcctgcatgccgcccccaccctgacgggggcgttcggggcccaccctgacgggtgcggtcggggcgtgccggggtcttttaggggcgcggggaactgcgcgagcaacccccacccacccgcaggtgcacgcggagcggcggacgccccgcagacgggggcaaaacgggcggagtgcccccgcccgccgggcggcgcgaattcgtaggtttaaggggcaggggtcagggcaggcgccgagccggtcaaccgcccccgtcccaggagaccccgtgacctcgaccggccacgcccgcaccgccgccatcgccatcggagccgccaccgccaccgtcctcggcgcgctgctggtcggcggctccggcgaggtgagtgcgagcccgccgcccgagcccaaggtccaggacgacttcgactccctcggccccgaggtgcgcgccgcgaagctctccgacgggcggacggcccactactcggacacgggcgacaaggacggcaagccggccctgttcatcggcggcaccggcacgagcgcccgcgcctcccacatgaccgacttcttccgctcgacgcgcgaggacctgggcctgcgcctcatctccgtggagcgcaacggcttcggcgacaccgcgttcgacgagaagctgggcaccgccgacttcgcgaaggacgccctcgaagtcctcgaccggctcgg

SEQ ID NO: 135 - protein, 136 aa, Streptomyces cinnamonensis
MGVAAGPIRVVVAKPGLDGHDRGAKVIARALRDAGMEVIYTGLHQTPEQVVDTAIQEDADAIGLSILSGAHNTLFARVLELLKERDAEDIKVFGGGIIPEADIAPLKEKGVAEIFTPGATTTSIVEWVRGNVRQAV

SEQ ID NO: 136 - DNA, 1643 bp, Streptomyces cinnamonensis
gtcgacctcccgtttggcgcacggaagggaggctctgtcccccgtgtgccctagggggagtcgtggtcgaggagtcggctgtgcgatggcgatcccggccaccgccctgcggtgactccgtgcccccgttgcatcgccgatgcgcggtgtcaccacgccgtgcggctgccggcgcggtggcccggcgtctcgttgcggctcccctcgcgcctggtccggatgcggagcgtgaacccctgggttacggacgggcgcgcagcgaacgtgtcccacgtgtgatttccccctcgctctccaccgcgaaactgccgcttgcgcgatgctggggataacgttcgttcacttccccggccggtgcggtgcggggtatctgtgccgggacagactttgtcggtacggatatcggtacatggaggcagtgatgggtgtggcagccgggccgatccgcgtggtggtcgccaagccggggctcgacgggcacgatcgcggggccaaggtgatcgcgcgggcgttgcgtgacgcgggtatggaggtcatctacaccgggctgcaccagacgcccgagcaggtggtggacaccgcgatccaggaggacgccgacgcgatcggcctctccatcctctccggagcgcacaacacgctgttcgcgcgcgtgttggagctcttgaaggagcgggacgcggaggacatcaaggtgtttggtggcggcatcatcccggaggcggacatcgcgccgctgaaggagaagggcgtcgcggagatcttcacgcccggggccaccaccacgtcgatcgtggagtgggttcgggggaacgtgcgacaggccgtctgaggcattccccgtcgcccgtctgccgtggtcggcgtcatatcggcggacatcgtctcggtggacgtcatggcggcggggggagttcgtcgcgtatcgccgcgcggaggcgcagggtggtgaccaggcgctggaacgcttccgaccagtagctgcccgcgccgggtgacgcgtcctccgcttcgtcggggaccgcggtgagcgcttccaggcggaccgcctcggccgggtccagacagcgttccgccaggcccatcactccgctgaagctccatgggtaactgcccgcgtcgcgcgcgatgttcagggcgtccaccacggcccggccgagagggccggcccagggcaccgcgcagacgccgagcagttggaacgcctccgacaggccgtgtgccgctatgaaccccgccacccagtccgcgcgctcggcggcaggcatggaggcgagcagtttggcccgctcggcgagggacacggcgccaggccccgccgcgtcgggtgaggcgggggcgccgagcagcgctctggaccaggcgacgtcacgctggcgtacggccgcgcggcaccatgcggcgtgcagttcgccccgccagtcgtcggccaccgggagcgccacgatctccgccggggtgcggttgccgagccggggcggccaggtggcgagcggggccgattccacgagctggccgagccaccaggagcgctcgccccggccggtggggggcttcgggacgacgccgtcccgctccatgcccgcgtcgcactcgtgcggcgcctcgacggtgagggtcggcgtgctcgatgtgtggtcgac

SEQ ID NO: 137 - protein, 566 aa, Streptomyces coelicolor
MDAHAIEEGRLRWQARYDAARKRDADFTTLSGDPVEPVYGPRPGDEYEGFERIGWPGEYPFTRGLYPTGYRGRTWTIRQFAGFGNAEQTNERYKMILRNGGGGLSVAFDMPTLMGRDSDDPRSLGEVGHCGVAIDSAADMEVLFKDIPLGDVTTSMTISGPAVPVFCMYLVAAERQGVDASVLNGTLQTDIFKEYIAQKEWLFQPEPHLRLIGDLMEYCAAGIPAYKPLSVSGYHIREAGATAAQELAYTLADGFGYVELGLSRGLDVDVFAPGLSFFFDAHLDFFEEIAKFRAARRIWARWMRDVYGARTDKAQWLRFHTQTAGVSLTAQQPYNNVVRTAVEALAAVLGGTNSLHTNALDETLALPSEQAAEIALRTQQVLMEETGVANVADPLGGSWFIEQLTDRIEADAEKIFEQIKERGLRAHPDGQHPVGPITSGLLRGIEDGWFTGEIAESAFRYQQSLEKDDKKVVGVNVHTGSVTGDLEILRVSHEVEREQVRVLGERKDARDDAAVRGALDAMLAAARSGGNMIGPMLDAVRAEATLGEICGVLRDEWGVYTEPAGF

SEQ ID NO: 138 - DNA, 1701 bp, Streptomyces coelicolor
atggacgctcatgccatagaggagggccgccttcgctggcaggcccggtacgacgcggcgcgcaagcgcgacgcggacttcaccacgctctccggagaccccgtggagccggtgtacgggccccgccccggggacgagtacgagggcttcgagcggatcggctggccgggcgagtaccccttcacccgcggcctgtatccgaccgggtaccgggggcgtacgtggaccatccggcagttcgccgggttcggcaacgccgagcagaccaacgagcgctacaagatgatcctccgcaacggcggcggcgggctctcggtcgccttcgacatgccgaccctgatgggccgcgactccgacgacccgcgctcgctgggcgaggtcgggcactgcggggtggccatcgactcggccgccgacatggaagtgctgttcaaggacatcccgctcggggacgtgacgacctccatgacgatcagcgggcccgccgtgcccgtgttctgcatgtacctcgtcgccgccgagcgccagggcgtcgacgcatccgtgctcaacggcacgctgcagaccgacatcttcaaggagtacatcgcccagaaggagtggctcttccagcccgagccccacctccggctcatcggcgacctcatggagtactgcgcggccggcatccccgcctacaagccgctctccgtctccggctaccacatccgcgaggcgggcgcgacggccgcgcaggagctggcgtacacgctcgccgacggcttcggatacgtggagctgggcctcagccgcgggctcgacgtggacgtcttcgcgcccggcctctccttcttcttcgacgcgcacctcgacttcttcgaggagatcgccaagttccgcgcggcccgcaggatctgggcccgctggatgcgcgacgtgtacggcgcgcggaccgacaaggcccagtggctgcggttccacacccagaccgccggagtctcgctcaccgcgcagcagccgtacaacaacgtcgtacgcaccgcggtggaggcgctggcggccgtgctcggcggcaccaactccctgcacaccaacgcgctcgacgagaccctcgccctgcccagcgagcaggccgccgagatcgccctgcgcacccagcaggtgctgatggaggagaccggcgtcgccaacgtcgccgacccgctgggcggttcctggttcatcgagcagctgaccgaccgcatcgaggccgacgccgagaagatcttcgagcagatcaaggagcgggggctgcgcgcccaccccgacgggcagcaccccgtcggaccgatcacctccggcctgctgcgcggcatcgaggacggctggttcaccggcgagatcgccgagtccgccttccgctaccagcagtccttggagaaggacgacaagaaggtggtcggcgtcaacgtccacaccggctccgtcaccggcgacctggagatcctgcgggtcagccacgaggtcgagcgcgagcaggtgcgggtcctgggcgagcgcaaggacgcccgggacgacgccgccgtgcgcggcgccctggacgccatgctggccgcggcccgctccggcggcaacatgatcgggccgatgctggacgcggtgcgcgcggaggcgacgctgggcgagatctgcggtgtgctgcgcgacgagtggggggtgtacacggaaccggcggggttctga

SEQ ID NO: 139 - protein, 138 aa, Streptomyces coelicolor
MGVAAGPIRVVVAKPGLDGHDRGAKVIARALRDAGMEVIYTGLHQTPEQIVDTAIQEDADAIGLSILSGAHNTLFAAVIELLRERDAADILVFGGGIIPEADIAPLKEKGVAEIFTPGATTASIVDWVRANVREPAGA

SEQ ID NO: 140 - DNA, 417 bp, Streptomyces coelicolor
atgggtgtggcagccggtccgatccgcgtggtggtggccaagccggggctcgacggccacgatcgcggggccaaggtgatcgcgagggccctgcgtgacgccggtatggaggtgatctacaccgggctccaccagacgcccgagcagatcgtcgacaccgcgatccaggaggacgccgacgcgatcgggctgtccatcctctccggtgcgcacaacacgctcttcgccgccgtgatcgagctgctccgggagcgggacgccgcggacatcctggtcttcggcggcgggatcatccccgaggcggacatcgccccgctgaaggagaagggcgtcgcggagatcttcacgcccggcgccaccacggcgtccatcgtggactgggtccgggcgaacgtgcgggagcccgcgggagcatag

SEQ ID NO: 141 - protein, 566 aa, Streptomyces avermitilis
MDADAIEEGRRRWQARYDASRKREADFTTLSGDPVEPAYGPRPGDAYEGFERIGWPGEYPFTRGLYPTGYRGRTWTIRQFAGFGNAEQTNERYKKILANGGGGLSVAFDMPTLMGRDSDDRRALGEVGHCGVAIDSAADMEVLFKDIPLGDVTTSMTISGPAVPVFCMYLVAAERQGVDPSVLNGTLQTDIFKEYIAQKEWLFQPEPHLRLIGDLMEHCASKIPAYKPLSVSGYHIREAGATAAQELAYTLADGFGYVELGLSRGLDVDVFAPGLSFFFDAHVDFFEEIAKFRAARRIWARWLRDVYGAKSEKAQWLRFHTQTAGVSLTAQQPYNNVVRTAVEALAAVLGGTNSLHTNALDETLALPSEQAAEIALRTQQVLMEETGVANVADPLGGSWYVEQLTDRIEADAEKIFEQIRERGLRAHPDGRHPIGPITSGILRGIEDGWFTGEIAESAFQYQQALEKGDKRVVGVNVHHGSVTGDLEILRVSHEVEREQVRVLGERKSGRDDTAVTAALDAMLAAARDGSNMIAPMLDAVRAEATLGEICDVLREEWGVYTEPAGF

SEQ ID NO: 142 - DNA, 1701 bp, Streptomyces avermitilis
tcagaaaccggcgggctccgtgtagaccccccactcctcccggaggacatcgcagatctcgcccagcgtggcctccgcgcggaccgcgtccagcatcggggcgatcatgttcgacccgtcgcgcgcggcggcgagcatcgcgtccagggccgcggttacggccgtgtcgtcgcgccccgacttccgctcgcccagcacccgcacctgctcgcgctccacctcgtggctgacgcgcaggatctccaggtcgcccgtcacggacccgtggtggacgttgacgccgacgacccgcttgtcgcccttctccagcgcctgctggtactggaaggccgactcggcgatctccccggtgaaccagccgtcctcgatgccgcgcaggatgccggaggtgatgggcccgatcgggtgccgcccgtccgggtgggcccgcagcccgcgctccctgatctgttcgaagatcttctcggcgtcggcctcgatccggtcggtcagctgctccacgtaccaggaaccgcccagcggatcggccacgttggcgacgcccgtctcctccatcagcacctgctgggtgcgcagggcgatctcggccgcctgctcggacggcagggcgagggtctcgtcgagggcgttggtgtgcagcgagttcgtcccgccgagcaccgcggcgagggcctccacggccgtccgtacgacgttgttgtacggctgctgcgcggtgagcgagacgcccgcggtctgggtgtggaagcgcagccactgcgccttctccgacttcgccccgtacacgtcccgcagccagcgcgcccagatgcgccgcgccgcacggaacttggcgatctcctcgaagaagtcgacgtgcgcgtcgaagaagaaggagagcccgggcgcgaacacgtccacgtccaggccgcggctcagccccagctccacgtatccgaaaccgtcggcgagggtgtacgccagctcctgggcggccgtggcaccggcctcccggatgtggtacccggagacggacagcggcttgtacgcggggatcttcgaggcgcagtgctccatcaggtcgccgatgagccgcagatggggctcgggctggaagagccactccttctgcgcgatgtactccttgaagatgtcggtctggagggtgccgttgaggacggaggggtcgacgccctgccgctcggccgcgaccaggtacatgcagaagacgggcacggcgggcccgctgatcgtcatcgacgtcgtcacgtcacccagcgggatgtccttgaacaggacctccatgtcggccgccgagtcgatcgcgaccccgcagtgcccgacctcgccgagcgcgcggcggtcgtcggagtcgcgccccatgagcgtcggcatgtcgaaggccacggacagcccaccgccgccgttggcgaggatcttcttgtagcgctcgttggtctgctcggcgttgccgaacccggcgaactgccggatggtccaggtccggccccggtagccggtcggatacagaccgcgcgtgaaggggtactcacccggccagccgatccgctcgaaaccctcgtacgcgtccccgggccggggcccgtacgccggctccacgggatcgccggagagcgtggtgaaatcggcctcgcgcttgcgtgaggcgtcgtagcgggcctgccagcgtcggcggccttcctcgatggcgtcagcgtccat

SEQ ID NO: 143 - protein, 138 aa, Streptomyces avermitilis
MGVAAGPIRVVVAKPGLDGHDRGAKVIARALRDAGMEVIYTGLHQTPEQIVGTAIQEDADAIGLSILSGAHNTLFAAVIDLLKERDAEDIKVFGGGIIPEADIAPLKEKGVAEIFTPGATTASIVEWVRANVRQPAGA

SEQ ID NO: 144 - DNA, 1701 bp, Streptomyces avermitilis; identical to SEQ ID NO: 142

SEQ ID NO: 145 - protein, 139 aa, Saccharomyces cerevisiae
MSEITLGKYLFERLKQVNVNTVFGLPGDFNLSLLDKIYEVEGMRWAGNANELNAAYAADGYARIKGMSCIITTFGVGELSALNGIAGSYAEHVGVLHVVGVPSISAQAKQLLLHHTLGNGDFTVFHRMSANISETTAMI

SEQ ID NO: 146 - DNA, 1689 bp, Saccharomyces cerevisiae
atgtctgaaattactttgggtaaatatttgttcgaaagattaaagcaagtcaacgttaacaccgttttcggtttgccaggtgacttcaacttgtccttgttggacaagatctacgaagttgaaggtatgagatgggctggtaacgccaacgaattgaacgctgcttacgccgctgatggttacgctcgtatcaagggtatgtcttgtatcatcaccaccttcggtgtcggtgaattgtctgctttgaacggtattgccggttcttacgctgaacacgtcggtgttttgcacgttgttggtgtcccatccatctctgctcaagctaagcaattgttgttgcaccacaccttgggtaacggtgacttcactgttttccacagaatgtctgccaacatttctgaaaccactgctatgatcactgacattgctaccgccccagctgaaattgacagatgtatcagaaccacttacgtcacccaaagaccagtctacttaggtttgccagctaacttggtcgacttgaacgtcccagctaagttgttgcaaactccaattgacatgtctttgaagccaaacgatgctgaatccgaaaaggaagtcattgacaccatcttggctttggtcaaggatgctaagaacccagttatcttggctgatgcttgttgttccagacacgacgtcaaggctgaaactaagaagttgattgacttgactcaattcccagctttcgtcaccccaatgggtaagggttccattgacgaacaacacccaagatacggtggtgtttacgtcggtaccttgtccaagccagaagttaaggaagccgttgaatctgctgacttgattttgtctgtcggtgctttgttgtctgatttcaacaccggttctttctcttactcttacaagaccaagaacattgtcgaattccactccgaccacatgaagatcagaaacgccactttcccaggtgtccaaatgaaattcgttttgcaaaagttgttgaccactattgctgacgccgctaagggttacaagccagttgctgtcccagctagaactccagctaacgctgctgtcccagcttctaccccattgaagcaagaatggatgtggaaccaattgggtaacttcttgcaagaaggtgatgttgtcattgctgaaaccggtacctccgctttcggtatcaaccaaaccactttcccaaacaacacctacggtatctctcaagtcttatggggttccattggtttcaccactggtgctaccttgggtgctgctttcgctgctgaagaaattgatccaaagaagagagttatcttattcattggtgacggttctttgcaattgactgttcaagaaatctccaccatgatcagatggggcttgaagccatacttgttcgtcttgaacaacgatggttacaccattgaaaagttgattcacggtccaaaggctcaatacaacgaaattcaaggttgggaccacctatccttgttgccaactttcggtgctaaggactatgaaacccacagagtcgctaccaccggtgaatgggacaagttgacccaagacaagtctttcaacgacaactctaagatcagaatgattgaaatcatgttgccagtcttcgatgctccacaaaacttggttgaacaagctaagttgactgctgctaccaacgctaagcaa

SEQ ID NO: 147 - protein, 563 aa, Saccharomyces cerevisiae
MSEITLGKYLFERLSQVNCNTVFGLPGDFNLSLLDKLYEVKGMRWAGNANELNAAYAADGYARIKGMSCIITTFGVGELSALNGIAGSYAEHVGVLHVVGVPSISSQAKQLLLHHTLGNGDFTVFHRMSANISETTAMITDIANAPAEIDRCIRTTYTTQRPVYLGLPANLVDLNVPAKLLETPIDLSLKPNDAEAEAEVVRTVVELIKDAKNPVILADACASRHDVKAETKKLMDLTQFPVYVTPMGKGAIDEQHPRYGGVYVGTLSRPEVKKAVESADLILSIGALLSDFNTGSFSYSYKTKNIVEFHSDHIKIRNATFPGVQMKFALQKLLDAIPEVVKDYKPVAVPARVPITKSTPANTPMKQEWMWNHLGNFLREGDIVIAETGTSAFGINQTTFPTDVYAIVQVLWGSIGFTVGALLGATMAAEELDPKKRVILFIGDGSLQLTVQEISTMIRWGLKPYIFVLNNNGYTIEKLIHGPHAEYNEIQGWDHLALLPTFGARNYETHRVATTGEWEKLTQDKDFQDNSKIRMIEVMLPVFDAPQNLVKQAQLTAATNAKQ

SEQ ID NO: 148 - DNA, 1689 bp, Saccharomyces cerevisiae
atgtctgaaataaccttaggtaaatatttatttgaaagattgagccaagtcaactgtaacaccgtcttcggtttgccaggtgactttaacttgtctcttttggataagctttatgaagtcaaaggtatgagatgggctggtaacgctaacgaattgaacgctgcctatgctgctgatggttacgctcgtatcaagggtatgtcctgtattattaccaccttcggtgttggtgaattgtctgctttgaatggtattgccggttcttacgctgaacatgtcggtgttttgcacgttgttggtgttccatccatctcttctcaagctaagcaattgttgttgcatcataccttgggtaacggtgacttcactgttttccacagaatgtctgccaacatttctgaaaccactgccatgatcactgatattgctaacgctccagctgaaattgacagatgtatcagaaccacctacactacccaaagaccagtctacttgggtttgccagctaacttggttgacttgaacgtcccagccaagttattggaaactccaattgacttgtctttgaagccaaacgacgctgaagctgaagctgaagttgttagaactgttgttgaattgatcaaggatgctaagaacccagttatcttggctgatgcttgtgcttctagacatgatgtcaaggctgaaactaagaagttgatggacttgactcaattcccagtttacgtcaccccaatgggtaagggtgctattgacgaacaacacccaagatacggtggtgtttacgttggtaccttgtctagaccagaagttaagaaggctgtagaatctgctgatttgatattgtctatcggtgctttgttgtctgatttcaataccggttctttctcttactcctacaagaccaaaaatatcgttgaattccactctgaccacatcaagatcagaaacgccaccttcccaggtgttcaaatgaaatttgccttgcaaaaattgttggatgctattccagaagtcgtcaaggactacaaacctgttgctgtcccagctagagttccaattaccaagtctactccagctaacactccaatgaagcaagaatggatgtggaaccatttgggtaacttcttgagagaaggtgatattgttattgctgaaaccggtacttccgccttcggtattaaccaaactactttcccaacagatgtatacgctatcgtccaagtcttgtggggttccattggtttcacagtcggcgctctattgggtgctactatggccgctgaagaacttgatccaaagaagagagttattttattcattggtgacggttctctacaattgactgttcaagaaatctctaccatgattagatggggtttgaagccatacatttttgtcttgaataacaacggttacaccattgaaaaattgattcacggtcctcatgccgaatataatgaaattcaaggttgggaccacttggccttattgccaacttttggtgctagaaactacgaaacccacagagttgctaccactggtgaatgggaaaagttgactcaagacaaggacttccaagacaactctaagattagaatgattgaagttatgttgccagtctttgatgctccacaaaacttggttaaacaagctcaattgactgccgctactaacgctaaacaa

SEQ ID NO: 149 - protein, 533 aa, Saccharomyces cerevisiae
MSEITLGKYLFERLKQVNVNTIFGLPGDFNLSLLDKIYEVDGLRWAGNANELNAAYAADGYARIKGLSVLVTTFGVGELSALNGIAGSYAEHVGVLHVVGVPSISAQAKQLLLHHTLGNGDFTVFHRMSANISETTSMITDIATAPSEIDRLIRTTFITQRPSYLGLPANLVDLKVPGSLLEKPIDLSLKPNDPEAEKEVIDTVLELIQNSKNPVILSDACASRHNVKKETQKLIDLTQFPAFVTPLGKGSIDEQHPRYGGVYVGTLSKQDVKQAVESADLILSVGALLSDFNTGSFSYSYKTKNVVEFHSDYVKVKNATFLGVQMKFALQNLLKVIPDVVKGYKSVPVPTKTPANKGVPASTPLKQEWLWNELSKFLQEGDVIISETGTSAFGINQTIFPKDAYGISQVLWGSIGFTTGATLGAAFAAEEIDPNKRVILFIGDGSLQLTVQEISTMIRWGLKPYLFVLNNDGYTIEKLIHGPHAEYNEIQTWDHLALLPAFGAKKYENHKIATTGEWDALTTDSEFQKNSVI

SEQ ID NO: 150 - DNA, 1599 bp, Saccharomyces cerevisiae
atgtctgaaattactcttggaaaatacttatttgaaagattgaagcaagttaatgttaacaccatttttgggctaccaggcgacttcaacttgtccctattggacaagatttacgaggtagatggattgagatgggctggtaatgcaaatgagctgaacgccgcctatgccgccgatggttacgcacgcatcaagggtttatctgtgctggtaactacttttggcgtaggtgaattatccgccttgaatggtattgcaggatcgtatgcagaacacgtcggtgtactgcatgttgttggtgtcccctctatctccgctcaggctaagcaattgttgttgcatcataccttgggtaacggtgattttaccgtttttcacagaatgtccgccaatatctcagaaactacatcaatgattacagacattgctacagccccttcagaaatcgataggttgatcaggacaacatttataacacaaaggcctagctacttggggttgccagcgaatttggtagatctaaaggttcctggttctcttttggaaaaaccgattgatctatcattaaaacctaacgatcccgaagctgaaaaggaagttattgataccgtactagaattgatccagaattcgaaaaaccctgttatactatcggatgcctgtgcttctaggcacaacgttaaaaaagaaacccagaagttaattgatttgacgcaattcccagcttttgtgacacctctaggtaaagggtcaatagatgaacagcatcccagatatggcggtgtttatgtgggaacgctgtccaaacaagacgtgaaacaggccgttgagtcggctgatttgatcctttcggtcggtgctttgctctctgattttaacacaggttcgttttcctactcctacaagactaaaaatgtagtggagtttcattccgattacgtaaaggtgaagaacgctacgttcctcggtgtacaaatgaaatttgcactacaaaacttactgaaggttattcccgatgttgttaagggctacaagagcgttcccgtaccaaccaaaactcccgcaaacaaaggtgtacctgctagcacgcccttgaaacaagagtggttgtggaacgaattgtccaaattcttgcaagaaggtgatgttatcatttccgagaccggcacgtctgccttcggtatcaatcaaactatctttcctaaggacgcctacggtatctcgcaggtgttgtgggggtccatcggttttacaacaggagcaactttaggtgctgcctttgccgctgaggagattgaccccaacaagagagtcatcttattcataggtgacgggtctttgcagttaaccgtccaagaaatctccaccatgatcagatgggggttaaagccgtatctttttgtccttaacaacgacggctacactatcgaaaagctgattcatgggcctcacgcagagtacaacgaaatccagacctgggatcacctcgccctgttgcccgcatttggtgcgaaaaagtacgaaaatcacaagatcgccactacgggtgagtgggatgccttaaccactgattcagagttccagaaaaactcggtgatc

SEQ ID NO: 151 - protein, 564 aa, Candida glabrata
MSEITLGRYLFERLNQVDVKTIFGLPGDFNLSLLDKIYEVEGMRWAGNANELNAAYAADGYARIKGMSCIITTFGVGELSALNGIAGSYAEHVGVLHVVGVPSISSQAKQLLLHHTLGNGDFTVFHRMSANISETTAMVTDIATAPAEIDRCIRTTYITQRPVYLGLPANLVDLKVPAKLLETPIDLSLKPNDPEAETEVVDTVLELIKAAKNPVILADACASRHDVKAETKKLIDATQFPSFVTPMGKGSIDEQHPRFGGVYVGTLSRPEVKEAVESADLILSVGALLSDFNTGSFSYSYKTKNIVEFHSDYIKIRNATFPGVQMKFALQKLLNAVPEAIKGYKPVPVPARVPENKSCDPATPLKQEWMWNQVSKFLQEGDVVITETGTSAFGINQTPFPNNAYGISQVLWGSIGFTTGACLGAAFAAEEIDPKKRVILFIGDGSLQLTVQEISTMIRWGLKPYLFVLNNDGYTIERLIHGEKAGYNDIQNWDHLALLPTFGAKDYENHRVATTGEWDKLTQDKEFNKNSKIRMIEVMLPVMDAPTSLIEQAKLTASINAKQE

SEQ ID NO: 152 - DNA, 1692 bp, Candida glabrata
atgtctgagattactttgggtagatacttgttcgagagattgaaccaagtcgacgttaagaccatcttcggtttgccaggtgacttcaacttgtccctattggacaagatctacgaagttgaaggtatgagatgggctggtaacgctaacgaattgaacgctgcttacgctgctgacggttacgctagaatcaagggtatgtcctgtatcatcaccaccttcggtgtcggtgaattgtctgccttgaacggtattgccggttcttacgctgaacacgtcggtgtcttgcacgtcgtcggtgtcccatccatctcctctcaagctaagcaattgttgttgcaccacaccttgggtaacggtgacttcactgtcttccacagaatgtccgctaacatctctgagaccaccgctatggtcactgacatcgctaccgctccagctgagatcgacagatgtatcagaaccacctacatcacccaaagaccagtctacttgggtctaccagctaacttggtcgacctaaaggtcccagccaagcttttggaaaccccaattgacttgtccttgaagccaaacgacccagaagccgaaactgaagtcgttgacaccgtcttggaattgatcaaggctgctaagaacccagttatcttggctgatgcttgtgcttccagacacgacgtcaaggctgaaaccaagaagttgattgacgccactcaattcccatccttcgttaccccaatgggtaagggttccatcgacgaacaacacccaagattcggtggtgtctacgtcggtaccttgtccagaccagaagttaaggaagctgttgaatccgctgacttgatcttgtctgtcggtgctttgttgtccgatttcaacactggttctttctcttactcttacaagaccaagaacatcgtcgaattccactctgactacatcaagatcagaaacgctaccttcccaggtgtccaaatgaagttcgctttgcaaaagttgttgaacgccgtcccagaagctatcaagggttacaagccagtccctgtcccagctagagtcccagaaaacaagtcctgtgacccagctaccccattgaagcaagaatggatgtggaaccaagtttccaagttcttgcaagaaggtgatgttgttatcactgaaaccggtacctccgcttttggtatcaaccaaaccccattcccaaacaacgcttacggtatctcccaagttctatggggttccatcggtttcaccaccggtgcttgtttgggtgccgctttcgctgctgaagaaatcgacccaaagaagagagttatcttgttcattggtgacggttctttgcaattgactgtccaagaaatctccaccatgatcagatggggcttgaagccatacttgttcgtcttgaacaacgacggttacaccatcgaaagattgattcacggtgaaaaggctggttacaacgacatccaaaactgggaccacttggctctattgccaaccttcggtgctaaggactacgaaaaccacagagtcgccaccaccggtgaatgggacaagttgacccaagacaaggaattcaacaagaactccaagatcagaatgatcgaagttatgttgccagttatggacgctccaacttccttgattgaacaagctaagttgaccgcttccatcaacgctaagcaagaa

SEQ ID NO: 153 - protein, 596 aa, Pichia stipitis
MAEVSLGRYLFERLYQLQVQTIFGVPGDFNLSLLDKIYEVEDAHGKNSFRWAGNANELNASYAADGYSRVKRLGCLVTTFGVGELSALNGIAGSYAEHVGLLHVVGVPSISSQAKQLLLHHTLGNGDFTVFHRMSNNISQTTAFISDINSAPAEIDRCIREAYVKQRPVYIGLPANLVDLNVPASLLESPINLSLEKNDPEAQDEVIDSVLDLIKKSSNPIILVDACASRHDCKAEVTQLIEQTQFPVFVTPMGKGTVDEGGVDGELLEDDPHLIAKVAARLSAGKNAASRFGGVYVGTLSKPEVKDAVESADLILSVGALLSDFNTGSFSYSYRTKNIVEFHSDYTKIRQATFPGVQMKEALQELNKKVSSAASHYEVKPVPKIKLANTPATREVKLTQEWLWTRVSSWFREGDIIITETGTSSFGIVQSRFPNNTIGISQVLWGSIGFSVGATLGAAMAAQELDPNKRTILFVGDGSLQLTVQEISTIIRWGTTPYLFVLNNDGYTIERLIHGVNASYNDIQPWQNLEILPTFSAKNYDAVRISNIGEAEDILKDKEFGKNSKIRLIEVMLPRLDAPSNLAKQAAITAATNAEA

SEQ ID NO: 154 - DNA, 1788 bp, Pichia stipitis
atggctgaagtctcattaggaagatatctcttcgagagattgtaccaattgcaagtgcagaccatcttcggtgtccctggtgatttcaacttgtcgcttttggacaagatctacgaagtggaagatgcccatggcaagaattcgtttagatgggctggtaatgccaacgaattgaatgcatcgtacgctgctgacggttactcgagagtcaagcgtttagggtgtttggtcactacctttggtgtcggtgaattgtctgctttgaatggtattgccggttcttatgccgaacatgttggtttgcttcatgtcgtaggtgttccatcgatttcctcgcaagctaagcaattgttacttcaccacactttgggtaatggtgatttcactgttttccatagaatgtccaacaacatttctcagaccacagcctttatctccgatatcaactcggctccagctgaaattgatagatgtatcagagaggcctacgtcaaacaaagaccagtttatatcgggttaccagctaacttagttgatttgaatgttccggcctctttgcttgagtctccaatcaacttgtcgttggaaaagaacgacccagaggctcaagatgaagtcattgactctgtcttagacttgatcaaaaagtcgctgaacccaatcatcttggtcgatgcctgtgcctcgagacatgactgtaaggctgaagttactcagttgattgaacaaacccaattcccagtatttgtcactccaatgggtaaaggtaccgttgatgagggtggtgtagacggagaattgttagaagatgatcctcatttgattgccaaggtcgctgctaggttgtctgctggcaagaacgctgcctctagattcggaggtgtttatgtcggaaccttgtcgaagcccgaagtcaaggacgctgtagagagtgcagatttgattttgtctgtcggtgcccttttgtctgatttcaacactggttcattttcctactcctacagaaccaagaacatcgtcgaattccattctgattacactaagattagacaagccactttcccaggtgtgcagatgaaggaagccttgcaagaattgaacaagaaagtttcatctgctgctagtcactatgaagtcaagcctgtgcccaagatcaagttggccaatacaccagccaccagagaagtcaagttaactcaggaatggttgtggaccagagtgtcttcgtggttcagagaaggtgatattattatcaccgaaaccggtacatcctccttcggtatagttcaatccagattcccaaacaacaccatcggtatctcccaagtattgtggggttctattggtttctctgttggtgccactttgggtgctgccatggctgcccaagaactcgaccctaacaagagaaccatcttgtttgttggagatggttctttgcaattgaccgttcaggaaatctccaccataatcagatggggtaccacaccttaccttttcgtgttgaacaatgacggttacaccatcgagcgtttgatccacggtgtaaatgcctcatataatgacatccaaccatggcaaaacttggaaatcttgcctactttctcggccaagaactacgacgctgtgagaatctccaacatcggagaagcagaagatatcttgaaagacaaggaattcggaaagaactccaagattagattgatagaagtcatgttaccaagattggatgcaccatctaaccttgccaaacaagctgccattacagctgccaccaacgccgaagct

SEQ ID NO: 155 - protein, 569 aa, Pichia stipitis
MVSTYPESEVTLGRYLFERLHQLKVDTIFGLPGDFNLSLLDKVYEVPDMRWAGNANELNAAYAADGYSRIKGLSCLVTTFGVGELSALNGVGGAYAEHVGLLHVVGVPSISSQAKQLLLHHTLGNGDFTVFHRMSNSISQTTAFLSDISIAPGQIDRCIREAYVHQRPVYVGLPANMVDLKVPSSLLETPIDLKLKQNDPEAQEVVETVLKLVSQATNPIILVDACALRHNCKEEVKQLVDATNFQVFTTPMGKSGISESHPRLGGVYVGTMSSPQVKKAVENADLILSVGSLLSDFNTGSFSYSYKTKNVVEFHSDYMKIRQATFPGVQMKEALQQLIKRVSSYINPSYIPTRVPKRKQPLKAPSEAPLTQEYLWSKVSGWFREGDIIVTETGTSAFGIIQSHFPSNTIGISQVLWGSIGFTVGATVGAAMAAQEIDPSRRVILFVGDGSLQLTVQEISTLCKWDCNNTYLYVLNNDGYTIERLIHGKSASYNDIQPWNHLSLLRLFNAKKYQNVRVSTAGELDSLFSDKKFASPDRIRMIEVMLSRLDAPANLVAQAKLSERVNLEN

SEQ ID NO: 156 - DNA, 1707 bp, Pichia stipitis
atggtatcaacctacccagaatcagaggttactctaggaaggtacctctttgagcgactccaccaattgaaagtggacaccattttcggcttgccgggtgacttcaacctttccttattggacaaagtgtatgaagttccggatatgaggtgggctggaaatgccaacgaattgaatgctgcctatgctgccgatggttactccagaataaagggattgtcttgcttggtcacaacttttggtgttggtgaattgtctgctttaaacggagttggtggtgcctatgctgaacacgtaggacttctacatgtcgttggagttccatccatatcgtcacaggctaaacagttgttgctccaccataccttgggtaatggtgacttcactgtttttcacagaatgtccaatagcatttctcaaactacagcatttctctcagatatctctattgcaccaggtcaaatagatagatgcatcagagaagcatatgttcatcagagaccagtttatgttggtttaccggcaaatatggttgatctcaaggttccttctagtctcttagaaactccaattgatttgaaattgaaacaaaatgatcctgaagctcaagaagttgttgaaacagtcctgaagttggtgtcccaagctacaaaccccattatcttggtagacgcttgtgccctcagacacaattgcaaagaggaagtcaaacaattggttgatgccactaattttcaagtctttacaactccaatgggtaaatctggtatctccgaatctcatccaagattgggcggtgtctatgtcgggacaatgtcgagtcctcaagtcaaaaaagccgttgaaaatgccgatcttatactatctgttggttcgttgttatcggacttcaatacaggttcattttcatactcctacaagacgaagaatgttgttgaattccactctgactatatgaaaatcagacaggccaccttcccaggagttcaaatgaaagaagccttgcaacagttgataaaaagggtctcttcttacatcaatccaagctacattcctactcgagttcctaaaaggaaacagccattgaaagctccatcagaagctcctttgacccaagaatatttgtggtctaaagtatccggctggtttagagagggtgatattatcgtaaccgaaactggtacatctgctttcggaattattcaatcccattttcccagcaacactatcggtatatcccaagtcttgtggggctcaattggtttcacagtaggtgcaacagttggtgctgccatggcagcccaggaaatcgaccctagcaggagagtaattttgttcgtcggtgatggttcattgcagttgacggttcaggaaatctctacgttgtgtaaatgggattgtaacaatacttatctttacgtgttgaacaatgatggttacactatagaaaggttgatccacggcaaaagtgccagctacaacgatatacagccttggaaccatttatccttgcttcgcttattcaatgctaagaaataccaaaatgtcagagtatcgactgctggagaattggactctttgttctctgataagaaatttgcttctccagataggataagaatgattgaggtgatgttatcgagattggatgcaccagcaaatcttgttgctcaagcaaagttgtctgaacgggtaaaccttgaaaat

SEQ ID NO: 157 - protein, 563 aa, Kluyveromyces lactis
MSEITLGRYLFERLKQVEVQTIFGLPGDFNLSLLDNIYEVPGMRWAGNANELNAAYAADGYARLKGMSCIITTFGVGELSALNGIAGSYAEHVGVLHVVGVPSVSSQAKQLLLHHTLGNGDFTVFHRMSSNISETTAMITDINTAPAEIDRCIRTTYVSQRPVYLGLPANLVDLTVPASLLDTPIDLSLKPNDPEAEEEVIENVLQLIKEAKNPVILADACCSRHDAKAETKKLIDLTQFPAFVTPMGKGSIDEKHPRFGGVYVGTLSSPAVKEAVESADLVLSVGALLSDFNTGSFSYSYKTKNIVEFHSDYTKIRSATFPGVQMKFALQKLLTKVADAAKGYKPVPVPSEPEHNEAVADSTPLKQEWVWTQVGEFLREGDVVITETGTSAFGINQTHFPNNTYGISQVLWGSIGFTTGATLGAAFAAEEIDPKKRVILFIGDGSLQLTVQEISTMIRWGLKPYLFVLNNDGYTIERLIHGETAQYNCIQNWQHLELLPTFGAKDYEAVRVSTTGEWNKLTTDEKFQDNTRIRLIEVMLPTMDAPSNLVKQAQLTAATNAKN

SEQ ID NO: 158 - DNA, 1689 bp, Kluyveromyces lactis
atgtctgaaattacattaggtcgttacttgttcgaaagattaaagcaagtcgaagttcaaaccatctttggtctaccaggtgatttcaacttgtccctattggacaatatctacgaagtcccaggtatgagatgggctggtaatgccaacgaattgaacgctgcttacgctgctgatggttacgccagattaaagggtatgtcctgtatcatcaccaccttcggtgtcggtgaattgtctgctttgaacggtattgccggttcttacgctgaacacgttggtgtcttgcacgttgtcggtgttccatccgtctcttctcaagctaagcaattgttgttgcaccacaccttgggtaacggtgacttcactgttttccacagaatgtcctccaacatttctgaaaccactgctatgatcaccgatatcaacactgccccagctgaaatcgacagatgtatcagaaccacttacgtttcccaaagaccagtctacttgggtttgccagctaacttggtcgacttgactgtcccagcttctttgttggacactccaattgatttgagcttgaagccaaatgacccagaagccgaagaagaagtcatcgaaaacgtcttgcaactgatcaaggaagctaagaacccagttatcttggctgatgcttgttgttccagacacgatgccaaggctgagaccaagaagttgatcgacttgactcaattcccagccttcgttaccccaatgggtaagggttccattgacgaaaagcacccaagattcggtggtgtctacgtcggtaccctatcttctccagctgtcaaggaagccgttgaatctgctgacttggttctatcggtcggtgctctattgtccgatttcaacactggttctttctcttactcttacaagaccaagaacattgtcgaattccactctgactacaccaagatcagaagcgctaccttcccaggtgtccaaatgaagttcgctttacaaaaattgttgactaaggttgccgatgctgctaagggttacaagccagttccagttccatctgaaccagaacacaacgaagctgtcgctgactccactccattgaagcaagaatgggtctggactcaagtcggtgaattcttgagagaaggtgatgttgttatcactgaaaccggtacctctgccttcggtatcaaccaaactcatttcccaaacaacacatacggtatctctcaagttttatggggttccattggtttcaccactggtgctaccttgggtgctgccttcgctgccgaagaaattgatccaaagaagagagttatcttattcattggtgacggttctttgcaattgactgttcaagaaatctccaccatgatcagatggggcttgaagccatacttgttcgtattgaacaacgacggttacaccattgaaagattgattcacggtgaaaccgctcaatacaactgtatccaaaactggcaacacttggaattattgccaactttcggtgccaaggactacgaagctgtcagagtttccaccactggtgaatggaacaagttgaccactgacgaaaagttccaagacaacaccagaatcagattgatcgaagttatgttgccaactatggatgctccatctaacttggttaagcaagctcaattgactgctgctaccaacgctaagaac

SEQ ID NO: 159 - protein, 571 aa, Yarrowia lipolytica
MSDSEPQMVDLGDYLFARFKQLGVDSVFGVPGDFNLTLLDHVYNVDMRWVGNTNELNAGYSADGYSRVKRLACLVTTFGVGELSAVAAVAGSYAEHVGVVHVVGVPSTSAENKHLLLHHTLGNGDFRVFAQMSKLISEYTHHIEDPSEAADVIDTAIRIAYTHQRPVYIAVPSNFSEVDIADQARLDTPLDLSLQPNDPESQYEVIEEICSRIKAAKKPVILVDACASRYRCVDETKELAKITNFAYFVTPMGKGSVDEDTDRYGGTYVGSLTAPATAEVVETADLIISVGALLSDFNTGSFSYSYSTKNVVELHSDHVKIKSATYNNVGMKMLFPPLLEAVKKLVAETPDFASKALAVPDTTPKIPEVPDDHITTQAWLWQRLSYFLRPTDIVVTETGTSSFGIIQTKFPHNVRGISQVLWGSIGYSVGAACGASIAAQEIDPQQRVILFVGDGSLQLTVTEISCMIRNNVKPYIFVLNNDGYTIERLIHGENASYNDVHMWKYSKILDTFNAKAHESIVVNTKGEMDALFDNEEFAKPDKIRLIEVMCDKMDAPASLIKQAELSAKTNV

SEQ ID NO: 160 - DNA, 1713 bp, Yarrowia lipolytica
atgagcgactccgaaccccaaatggtcgacctgggcgactatctctttgcccgattcaagcagctaggcgtggactccgtctttggagtgcccggcgacttcaacctcaccctgttggaccacgtgtacaatgtcgacatgcggtgggttgggaacacaaacgagctgaatgccggctactcggccgacggctactcccgggtcaagcggctggcatgtcttgtcaccacctttggcgtgggagagctgtctgccgtggctgctgtggcaggctcgtacgccgagcatgtgggcgtggtgcatgttgtgggcgttcccagcacctctgctgagaacaagcatctgctgctgcaccacacactcggtaacggcgacttccgggtctttgcccagatgtccaaactcatctccgagtacacccaccatattgaggaccccagcgaggctgccgacgtaatcgacaccgccatccgaatcgcctacacccaccagcggcccgtttacattgctgtgccctccaacttctccgaggtcgatattgccgaccaggctagactggatacccccctggacctttcgctgcagcccaacgaccccgagagccagtacgaggtgattgaggagatttgctcgcgtatcaaggccgccaagaagcccgtgattctcgtcgacgcctgcgcttcgcgatacagatgtgtggacgagaccaaggagctggccaagatcaccaactttgcctactttgtcactcccatgggtaagggttctgtggacgaggatactgaccggtacggaggaacatacgtcggatcgctgactgctcctgctactgccgaggtggttgagacagctgatctcatcatctccgtaggagctcttctgtcggacttcaacaccggttccttctcgtactcctactccaccaaaaacgtggtggaattgcattcggaccacgtcaaaatcaagtccgccacctacaacaacgtcggcatgaaaatgctgttcccgcccctgctcgaagccgtcaagaaactggttgccgagacccctgactttgcatccaaggctctggctgttcccgacaccactcccaagatccccgaggtacccgatgatcacattacgacccaggcatggctgtggcagcgtctcagttactttctgaggcccaccgacatcgtggtcaccgagaccggaacctcgtcctttggaatcatccagaccaagttcccccacaacgtccgaggtatctcgcaggtgctgtggggctctattggatactcggtgggagcagcctgtggagcctccattgctgcacaggagattgacccccagcagcgagtgattctgtttgtgggcgacggctctcttcagctgacggtgaccgagatctcgtgcatgatccgcaacaacgtcaagccgtacatttttgtgctcaacaacgacggctacaccatcgagaggctcattcacggcgaaaacgcctcgtacaacgatgtgcacatgtggaagtactccaagattctcgacacgttcaacgccaaggcccacgagtcgattgtggtcaacaccaagggcgagatggacgctctgttcgacaacgaagagtttgccaagcccgacaagatccggctcattgaggtcatgtgcgacaagatggacgcgcctgcctcgttgatcaagcaggctgagctctctgccaagaccaacgtt

SEQ ID NO: 161 - protein, 571 aa, Schizosaccharomyces pombe
MSGDILVGEYLFKRLEQLGVKSILGVPGDFNLALLDLIEKVGDEKFRWVGNTNELNGAYAADGYARVNGLSAIVTTFGVGELSAINGVAGSYAEHVPVVHIVGMPSTKVQDTGALLHHTLGDGDFRTFMDMFKKVSAYSIMIDNGNDAAEKIDEALSICYKKARPVYIGIPSDAGYFKASSSNLGKRLKLEEDTNDPAVEQEVINHISEMVVNAKKPVILIDACAVRHRVVPEVHELIKLTHFPTYVTPMGKSAIDETSQFFDGVYVGSISDPEVKDRIESTDLLLSIGALKSDFNTGSFSYHLSQKNAVEFHSDHMRIRYALYPNVAMKYILRKLLKVLDASMCHSKAAPTIGYNIKPKHAEGYSSNEITHCWFWPKFSEFLKPRDVLITETGTANFGVLDCRFPKDVTAISQVLWGSIGYSVGAMFGAVLAVHDSKEPDRRTILVVGDGSLQLTITEISTCIRHNLKPIIFIINNDGYTIERLIHGLHASYNEINTKWGYQQIPKFFGAAENHFRTYCVKTPTDVEKLFSDKEFANADVIQVVELVMPMLDAPRVLVEQAKLTSKINKQ

SEQ ID NO: 162 - DNA, 1713 bp, Schizosaccharomyces pombe
atgagtggggatattttagtcggtgaatatctattcaaaaggcttgaacaattaggggtcaagtccattcttggtgttccaggagatttcaatttagctctacttgacttaattgagaaagttggagatgagaaatttcgttgggttggcaataccaatgagttgaatggtgcttatgccgctgatggttatgctcgtgttaatggtctttcagccattgttacaacgttcggcgtgggagagctttccgctattaatggagtggcaggttcttatgcggagcatgtcccagtagttcatattgttggaatgccttccacaaaggtgcaagatactggagctttgcttcatcatactttaggagatggagactttcgcactttcatggatatgtttaagaaagtttctgcctacagtataatgatcgataacggaaacgatgcagctgaaaagatcgatgaagccttgtcgatttgttataaaaaggctaggcctgtttacattggtattccttctgatgctggctacttcaaagcatcttcatcaaatcttgggaaaagactaaagctcgaggaggatactaacgatccagcagttgagcaagaagtcatcaatcatatctcggaaatggttgtcaatgcaaagaaaccagtgattttaattgacgcttgtgctgtaagacatcgtgtcgttccagaagtacatgagctgattaaattgacccatttccctacatatgtaactcccatgggtaaatctgcaattgacgaaacttcgcaattttttgacggcgtttatgttggttcaatttcagatcctgaagttaaagacagaattgaatccactgatctgttgctatccatcggtgctctcaaatcagactttaacacgggttccttctcttaccacctcagccaaaagaatgccgttgagtttcattcagaccacatgcgcattcgatatgctctttatccaaatgtagccatgaagtatattcttcgcaaactgttgaaagtacttgatgcttctatgtgtcattccaaggctgctcctaccattggctacaacatcaagcctaagcatgcggaaggatattcttccaacgagattactcattgctggttttggcctaaatttagtgaatttttgaagccccgagatgttttgatcaccgagactggaactgcaaactttggtgtccttgattgcaggtttccaaaggatgtaacagccatttcccaggtattatggggatctattggatactccgttggtgcaatgtttggtgctgttttggccgtccacgattctaaagagcccgatcgtcgtaccattcttgtagtaggtgatggatccttacaactgacgattacagagatttcaacctgcattcgccataacctcaaaccaattattttcataattaacaacgacggttacaccattgagcgtttaattcatggtttgcatgctagctataacgaaattaacactaaatggggctaccaacagattcccaagtttttcggagctgctgaaaaccacttccgcacttactgtgttaaaactcctactgacgttgaaaagttgtttagcgacaaggagtttgcaaatgcagatgtcattcaagtagttgagcttgtaatgcctatgttggatgcacctcgtgtcctagttgagcaagccaagttgacgtctaagatcaataagcaa

SEQ ID NO: 163 - protein, 563 aa, Zygosaccharomyces rouxii
MSEITLGRYLFERLKQVDTNTIFGVPGDFNLSLLDKVYEVQGLRWAGNANELNAAYAADGYARVKGLAALITTFGVGELSALNGIAGSYAEHVGVLHIVGVPSVSSQAKQLLLHHTLGNGDFTVFHRMSANISETTAMLTDITAAPAEIDRCIRVAYVNQRPVYLGLPANLVDQKVPASLLNTPIDLSLKENDPEAETEVVDTVLELIKEAKNPVILADACCSRHDVKAETKKLIDLTQFPSFVTPMGKGSIDEQNPRFGGVYVGTLSSPEVKEAVESADLVLSVGALLSDFNTGSFSYSYKTKNVVEFHSDHIKIRNATFPGVQMKFVLKKLLQAVPEAVKNYKPGPVPAPPSPNAEVADSTTLKQEWLWRQVGSFLREGDVVITETGTSAFGINQTHFPNQTYGISQVLWGSIGYTTGSTLGAAFAAEEIDPKKRVILFIGDGSLQLTVQEISTMIRWGLKPYLFVLNNDGYTIERLIHGETAEYNCIQPWKHLELLNTFGAKDYENHRVSTVGEWNKLTQDPKFNENSRIRMIEVMLEVMDAPSSLVAQAQLTAATNAKQ

SEQ ID NO: 164 - DNA, 1689 bp, Zygosaccharomyces rouxii
atgtctgaaattactctaggtcgttacttgttcgaaagattaaagcaagttgacactaacaccatcttcggtgttccaggtgacttcaacttgtccttgttggacaaggtctacgaagtgcaaggtctaagatgggctggtaacgctaacgaattgaacgctgcctacgctgctgacggttacgccagagttaagggtttggctgctttgatcaccaccttcggtgtcggtgaattgtctgctttgaacggtattgcaggttcttacgctgaacacgttggtgttttgcacattgttggtgttccatctgtctcttctcaagctaagcaattgttgttgcaccacaccttgggtaacggtgacttcactgttttccacagaatgtccgccaacatctctgaaaccaccgctatgttgaccgacatcactgctgctccagctgaaattgaccgttgcatcagagttgcttacgtcaaccaaagaccagtctacttgggtctaccagctaacttggttgaccaaaaggtcccagcttctttgttgaacactccaattgatctatctctaaaggagaacgacccagaagctgaaaccgaagttgttgacaccgttttggaattgatcaaggaagctaagaacccagttatcttggctgatgcttgctgctccagacacgacgtcaaggctgaaaccaagaagttgatcgacttgactcaattcccatctttcgttactcctatgggtaagggttccatcgacgaacaaaacccaagattcggtggtgtctacgtcggtactctatccagcccagaagttaaggaagctgttgaatctgctgacttggttctatctgtcggtgctctattgtccgatttcaacactggttctttctcttactcttacaagaccaagaacgttgttgaattccactctgaccacatcaagatcagaaacgctaccttcccaggtgttcaaatgaaattcgttttgaagaaactattgcaagctgtcccagaagctgtcaagaactacaagccaggtccagtcccagctccgccatctccaaacgctgaagttgctgactctaccaccttgaagcaagaatggttatggagacaagtcggtagcttcttgagagaaggtgatgttgttattaccgaaactggtacctctgctttcggtatcaaccaaactcacttccctaaccaaacttacggtatctctcaagtcttgtggggttctattggttacaccactggttccactttgggtgctgccttcgctgctgaagaaattgaccctaagaagagagttatcttgttcattggtgacggttctctacaattgaccgttcaagaaatctccaccatgatcagatggggtctaaagccatacttgttcgttttgaacaacgatggttacaccattgaaagattgattcacggtgaaaccgctgaatacaactgtatccaaccatggaagcacttggaattgttgaacaccttcggtgccaaggactacgaaaaccacagagtctccactgtcggtgaatggaacaagttgactcaagatccaaaattcaacgaaaactctagaattagaatgatcgaagttatgcttgaagtcatggacgctccatcttctttggtcgctcaagctcaattgaccgctgctactaacgctaagcaa

SEQ ID NO: 165 - protein, 267 aa, Saccharomyces cerevisiae
MSQGRKAAERLAKKTVLITGASAGIGKATALEYLEASNGDMKLILAARRLEKLEELKKTIDQEFPNAKVHVAQLDITQAEKIKPFIENLPQEFKDIDILVNNAGKALGSDRVGQIATEDIQDVFDTNVTALINITQAVLPIFQAKNSGDIVNLGSIAGRDAYPTGSIYCASKFAVGAFTDSLRKELINTKIRVILIAPGLVETEFSLVRYRGNEEQAKNVYKDTTPLMADDVADLIVYATSRKQNTVIADTLIFPTNQASPHHIFRG

SEQ ID NO: 166 - DNA, 804 bp, Saccharomyces cerevisiae
atgtcccaaggtagaaaagctgcagaaagattggctaagaagactgtcctcattacaggtgcatctgctggtattggtaaggcgaccgcattagagtacttggaggcatccaatggtgatatgaaactgatcttggctgctagaagattagaaaagctcgaggaattgaagaagaccattgatcaagagtttccaaacgcaaaagttcatgtggcccagctggatatcactcaagcagaaaaaatcaagcccttcattgaaaacttgccacaagagttcaaggatattgacattctggtgaacaatgccggaaaggctcttggcagtgaccgtgtgggccagatcgcaacggaggatatccaggacgtgtttgacaccaacgtcacggctttaatcaatatcacacaagctgtactgcccatattccaagccaagaattcaggagatattgtaaatttgggttcaatcgctggcagagacgcatacccaacaggttctatctattgtgcctctaagtttgccgtgggggcgttcactgatagtttgagaaaggagctcatcaacactaaaattagagtcattctaattgcaccagggctagtcgagactgaattttcactagttagatacagaggtaacgaggaacaagccaagaatgtttacaaggatactaccccattgatggctgatgacgtggctgatctgatcgtctatgcaacttccagaaaacaaaatactgtaattgcagacactttaatctttccaacaaaccaagcgtcacctcatcatatcttccgtggataa

SEQ ID NO: 167 - DNA, 33 bp, Artificial Sequence
  YAP1-F-XbaI-EcoRI primer
gttgtctagaattcccatgagtgtgtctaccgc

SEQ ID NO: 168 - DNA, 30 bp, Artificial Sequence
  YAP-R-XhoI primer
ccaggagctctcaagttcccgctttagttc

SEQ ID NO: 169 - DNA, 4898 bp, Artificial Sequence
  p416 TEF vector
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccgggggatccactagttctagagcggccgccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtc

SEQ ID NO: 170 - DNA, 23 bp, Artificial Sequence
  p416 Forward  primer
gctcattagaaagaaagcatagc

SEQ ID NO: 171 - DNA, 25 bp, Artificial Sequence
  p416 Reverse primer
gacttcaggttgtctaactccttcc

SEQ ID NO: 172 - DNA, 20 bp, Artificial Sequence
  YAP1306F primer
tcagcagcaaaatgaagtgg

SEQ ID NO: 173 - DNA, 20 bp, Artificial Sequence
  YAP1769R primer
accaatccatcgaagtggag

SEQ ID NO: 174 - DNA, 20 bp, Artificial Sequence
  YAP1961F primer
cccatctcggctcttgataa

SEQ ID NO: 175 - DNA, 20 bp, Artificial Sequence
  YAP11368R primer
cagtaggctgggattggtgt

SEQ ID NO: 176 - DNA, 20 bp, Artificial Sequence
  YAP1488R primer
aattggctcgctattgctgt

SEQ ID NO: 177 - DNA, 20 bp, Artificial Sequence
  YAP11647R primer
ttgtttcggaagctctggtt

SEQ ID NO: 178 - DNA, 1953 bp, Artificial Sequence
  D8-1 variant
atgagtgtgtctaccgccaagaggtcgctggatgtcgtttctccgggttcattagcggagtttgagggttcaaaatctcgtcacgatgaaatagaaaatgaacatagacgtactggtacacgtgatggcgaggatagcgagcaaccgaagaagaagggtagcaaaactagcaaaaagcaagatttggatcctgaaactaagcagaagaggactgcccaaaatcgggccgctcaaagagcttttagggaacgtaaggagaggaagatgaaggaattggagaagaaggtacaaagtttagagagtattcagcagcaaaatgaagtggaagctacttttttgagggaccagttaatcactctggtgaatgagttaaaaaaatatagaccagagacaagaaatgactcaaaagtgctggaatatttagcaaggcgagatcctaatttgcatttttcaaaaaataacgttaaccacagcaatagcgagccaattgacacacccaatgatgacatacaagaaaatgttaaacaaaagatgaatttcacgtttcaatatccgcttgataacgacaacgacaacgacaacagtaaaaatgtggggaaacaattaccttcaccaaatgatccaagtcattcggctcctatgcctataaatcagacacaaaagaaattaagtgacgctacagattcctccagcgctactttggattccctttcaaatagtaacgatgttcttaataacacaccaaactcctccacttcgatggattggttagataatgtaatatatactaacaggtttgtgtcaggtgatgatggcagcaatagtaaaactaagaatttagacagtaatatgttttctaatgactttaattttgaaaaccaatttgatgaacaagtttcggagttttgttcgaaaatgaaccaggtatgtggaacaaggcaatgtcccattcccaagaaacccatctcggctcttgataaagaagttttcgcgtcatcttctatactaagttcaaattctcctgctttaacaaatacttgggaatcacattctaatattacagataatactcctgctaatgtcattgctactgatgctactaaatatgaaaattccttctccggttttggccgacttggtttcgatatgagtgccaatcattacgtcgtgaatgataatagcactggtagcactgatagcactggtagcactggcaataagaacaaaaagaacaataataatagcgatgatgtactcccattcatatccgagtcaccgtttgatatgaaccaagttactaatttttttagtccgggatctaccggcatcggcaataatgctgcctctaacaccaatcccagcctactgcaaagcagcaaagaggatataccttttatcaacgcaaatctggctttcccagacgacaattcaactaatattcaattacaacctttctctgaatctcaatctcaaaataagtttgactacgacatgttttttagagattcatcgaaggaaggtaacaatttatttggagagtttttagaggatgacgatgatgacaaaaaagccgctaatatgtcagacgatgagtcaagtttaatcaagaaccagttaattaacgaagaaccagagcttccgaaacaatatctacaatcggtaccaggaaatgaaagcgaaatctcacaaaaaaatggcagtagtttgcagaatgctgacaaaatcaataatggcaatgataacgataatgataatgatgtcgttccatctaaggaaggctctttactaaggtgttcggaaatttgggatagaataacaacacatccgaaatactcagatattgatgtcgatggtttatgttccgagctaatggcaaaggcaaaatgttcagaaagaggggttgtcatcaatgcagaagacgttcaattagctttgaataagcatatgaactaa

SEQ ID NO: 179 - DNA, 4582 bp, Artificial Sequence
  pLA54 plasmid
gggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgagccataccaaacgacgagcgtgacaccacgatgcctgtagcaatggcaacaacgttgcgcaaactattactggcgaactacttactctagcttcccggcaacaattaatagactggatggaggcggataaagttgcaggaccacttctgcgctcggcccttccggctggctggtttattgctgataaatctggagccggtgagcgtggtctcgcggtatcattgcagcactggggccagatggtaagccctcccgtatcgtagttatctacacgacgggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagaggatccccgcattgcggattacgtattctaatgttcagataacttcgtatagcatacattatacgaagttatctagggattcataaccattttctcaatcgaattacacagaacacaccgtacaaacctctctatcataactacttaatagtcacacacgtactcgtctaaatacacatcatcgtcctacaagttcatcaaagtgttggacagacaactataccagcatggatctcttgtatcggttcttttctcccgctctctcgcaataacaatgaacactgggtcaatcatagcctacacaggtgaacagagtagcgtttatacagggtttatacggtgattcctacggcaaaaatttttcatttctaaaaaaaaaaagaaaaatttttctttccaacgctagaaggaaaagaaaaatctaattaaattgatttggtgattttctgagagttccctttttcatatatcgaattttgaatataaaaggagatcgaaaaaatttttctattcaatctgttttctggttttatttgatagtttttttgtgtattattattatggattagtactggtttatatgggtttttctgtataacttctttttattttagtttgtttaatcttattttgagttacattatagttccctaactgcaagagaagtaacattaaaactcgagatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaagtttaacttgatactactagattttttctcttcatttataaaatttttggttataattgaagctttagaagtatgaaaaaatccttttttttcattctttgcaaccaaaataagaagcttcttttattcattgaaatgatgaatataaacctaacaaaagaaaaagactcgaatatcaaacattaaaaaaaaataaaagaggttatctgttttcccatttagttggagtttgcattttctaatagatagaactctcaattaatgtggatttagtttctctgttcgtttttttttgttttgttctcactgtatttacatttctatttagtatttagttattcatataatctataacttcgtatagcatacattatacgaagttatccagtgatgatacaacgagttagccaaggtg

SEQ ID NO: 180 - DNA, 80 bp, Artificial Sequence
  BK505 primer
ttccggtttctttgaaatttttttgattcggtaatctccgagcagaaggagcattgcggattacgtattctaatgttcag

SEQ ID NO: 181 - DNA, 81 bp, Artificial Sequence
  BK506 primer
gggtaataactgatataattaaattgaagctctaatttgtgagtttagtacaccttggctaactcgttgtatcatcactgg

SEQ ID NO: 182 - DNA, 38 bp, Artificial Sequence
  LA468 primer
gcctcgagttttaatgttacttctcttgcagttaggga

SEQ ID NO: 183 - DNA, 31 bp, Artificial Sequence
  LA492 primer
gctaaattcgagtgaaacacaggaagaccag

SEQ ID NO: 184 - DNA, 4236 bp, Artificial Sequence
  pLA33 plasmid
aaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagaggatccgcattgcggattacgtattctaatgttcagataacttcgtatagcatacattatacgaagttatgcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtatagcatacattatacgaagttatccagtgatgatacaacgagttagccaaggtgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaa

SEQ ID NO: 185 - DNA, 80 bp, Artificial Sequence
  Primer 315
cttcgaagaatatactaaaaaatgagcaggcaagataaacgaaggcaaaggcattgcggattacgtattctaatgttcag

SEQ ID NO: 186 - DNA, 81 bp, Artificial Sequence
  Primer 316
tatacacatgtatatatatcgtatgctgcagctttaaataatcggtgtcacaccttggctaactcgttgtatcatcactgg

SEQ ID NO: 187 - DNA, 22 bp, Artificial Sequence
  Primer 92
gagaagatgcggccagcaaaac

SEQ ID NO: 188 - DNA, 25 bp, Artificial Sequence
  Primer 346
ggaataccacttgccacctatcacc

SEQ ID NO: 189 - DNA, 7555 bp, Artificial Sequence
  pRS423::GAL1p-cre plasmid
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgattagaagccgccgagcgggcgacagccctccgacggaagactctcctccgtgcgtcctcgtcttcaccggtcgcgttcctgaaacgcagatgtgcctcgcgccgcactgctccgaacaataaagattctacaatactagcttttatggttatgaagaggaaaaattggcagtaacctggccccacaaaccttcaaattaacgaatcaaattaacaaccataggatgataatgcgattagttttttagccttatttctggggtaattaatcagcgaagcgatgatttttgatctattaacagatatataaatggaaaagctgcataaccactttaactaatactttcaacattttcagtttgtattacttcttattcaaatgtcataaaagtatcaacaaaaaattgttaatatacctctatactttaacgtcaaggagaaaaatgtccaatttactgcccgtacaccaaaatttgcctgcattaccggtcgatgcaacgagtgatgaggttcgcaagaacctgatggacatgttcagggatcgccaggcgttttctgagcatacctggaaaatgcttctgtccgtttgccggtcgtgggcggcatggtgcaagttgaataaccggaaatggtttcccgcagaacctgaagatgttcgcgattatcttctatatcttcaggcgcgcggtctggcagtaaaaactatccagcaacatttgggccagctaaacatgcttcatcgtcggtccgggctgccacgaccaagtgacagcaatgctgtttcactggttatgcggcggatccgaaaagaaaacgttgatgccggtgaacgtgcaaaacaggctctagcgttcgaacgcactgatttcgaccaggttcgttcactcatggaaaatagcgatcgctgccaggatatacgtaatctggcatttctggggattgcttataacaccctgttacgtatagccgaaattgccaggatcagggttaaagatatctcacgtactgacggtgggagaatgttaatccatattggcagaacgaaaacgctggttagcaccgcaggtgtagagaaggcacttagcctgggggtaactaaactggtcgagcgatggatttccgtctctggtgtagctgatgatccgaataactacctgttttgccgggtcagaaaaaatggtgttgccgcgccatctgccaccagccagctatcaactcgcgccctggaagggatttttgaagcaactcatcgattgatttacggcgctaaggatgactctggtcagagatacctggcctggtctggacacagtgcccgtgtcggagccgcgcgagatatggcccgcgctggagtttcaataccggagatcatgcaagctggtggctggaccaatgtaaatattgtcatgaactatatccgtaacctggatagtgaaacaggggcaatggtgcgcctgctggaagatggcgattaggagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtgttctagagcggccgccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtc

SEQ ID NO: 190 - DNA, 22 bp, Artificial Sequence
  oBP440 primer
tacgtacggaccaatcgaagtg

SEQ ID NO: 191 - DNA, 49 bp, Artificial Sequence
  oBP441 primer
aattcgtttgagtacactactaatggctttgttggcaatatgtttttgc

SEQ ID NO: 192 - DNA, 49 bp, Artificial Sequence
  oBP442 primer
atatagcaaaaacatattgccaacaaagccattagtagtgtactcaaac

SEQ ID NO: 193 - DNA, 49 bp, Artificial Sequence
  oBP443 primer
tatggaccctgaaaccacagccacattcttgttatttataaaaagacac

SEQ ID NO: 194 - DNA, 49 bp, Artificial Sequence
  oBP444 primer
ctcccgtgtctttttataaataacaagaatgtggctgtggtttcagggt

SEQ ID NO: 195 - DNA, 49 bp, Artificial Sequence
  oBP445 primer
taccgtaggcgtccttaggaaagatagaaggccatgaagctttttcttt

SEQ ID NO: 196 - DNA, 49 bp, Artificial Sequence
  oBP446 primer
attggaaagaaaaagcttcatggccttctatctttcctaaggacgccta

SEQ ID NO: 197 - DNA, 21 bp, Artificial Sequence
  oBP447 primer
ttattgtttggcatttgtagc

SEQ ID NO: 198 - DNA, 22 bp, Artificial Sequence
  oBP448 primer
ccaagcatctcataaacctatg

SEQ ID NO: 199 - DNA, 22 bp, Artificial Sequence
  oBP449 primer
tgtgcagatgcagatgtgagac

SEQ ID NO: 200 - DNA, 17 bp, Artificial Sequence
  oBP554 primer
agttattgataccgtac

SEQ ID NO: 201 - DNA, 19 bp, Artificial Sequence
  oBP555 primer
cgagataccgtaggcgtcc

SEQ ID NO: 202 - DNA, 24 bp, Artificial Sequence
  oBP513 primer
ttatgtatgctcttctgacttttc

SEQ ID NO: 203 - DNA, 49 bp, Artificial Sequence
  oBP515 primer
aataattagagattaaatcgctcattttttgccagtttcttcaggcttc

SEQ ID NO: 204 - DNA, 49 bp, Artificial Sequence
  oBP516 primer
agcctgaagaaactggcaaaaaatgagcgatttaatctctaattattag

SEQ ID NO: 205 - DNA, 49 bp, Artificial Sequence
  oBP517 primer
tatggaccctgaaaccacagccacatttttcaatcattggagcaatcat

SEQ ID NO: 206 - DNA, 49 bp, Artificial Sequence
  oBP518 primer
taaaatgattgctccaatgattgaaaaatgtggctgtggtttcagggtc

SEQ ID NO: 207 - DNA, 49 bp, Artificial Sequence
  oBP519 primer
accgtaggtgttgtttgggaaagtggaaggccatgaagctttttctttc

SEQ ID NO: 208 - DNA, 49 bp, Artificial Sequence
  oBP520 primer
ttggaaagaaaaagcttcatggccttccactttcccaaacaacacctac

SEQ ID NO: 209 - DNA, 23 bp, Artificial Sequence
  oBP521 primer
ttattgcttagcgttggtagcag

SEQ ID NO: 210 - DNA, 21 bp, Artificial Sequence
  oBP511 primer
tttttggtggttccggcttcc

SEQ ID NO: 211 - DNA, 22 bp, Artificial Sequence
  oBP512 primer
aaagttggcatagcggaaactt

SEQ ID NO: 212 - DNA, 16 bp, Artificial Sequence
  oBP550 primer
gtcattgacaccatct

SEQ ID NO: 213 - DNA, 19 bp, Artificial Sequence
  oBP551 primer
agagataccgtaggtgttg

SEQ ID NO: 214 - DNA, 28 bp, Artificial Sequence
  ilvDSm(1354F) primer
ggaccaaagggcggtcctggtatgcctg

SEQ ID NO: 215 - DNA, 26 bp, Artificial Sequence
  ilvDSm(788R) primer
gcttcacgcgttaaaatgtcagaagg

SEQ ID NO: 216 - DNA, 23 bp, Artificial Sequence
  MAT1 primer
agtcacatcaagatcgtttatgg

SEQ ID NO: 217 - DNA, 23 bp, Artificial Sequence
  MAT2 primer
gcacggaatatgggcatacttcg

SEQ ID NO: 218 - DNA, 23 bp, Artificial Sequence
  MAT3 primer
actccacttcaagtaagagtttg

SEQ ID NO: 219 - DNA, 29 bp, Artificial Sequence
  T-A(PDC5) primer
ctgtcgctaacacctgtatggttgcaacc

SEQ ID NO: 220 - DNA, 48 bp, Artificial Sequence
  B-A(kivD) primer
gatagtcacctactgtatacattttgttcttcttgttattgtattgtg

SEQ ID NO: 221 - DNA, 15539 bp, Artificial Sequence
  pLH468 plasmid
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggcgcgccactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccacccgggccccccctcgaggtcgacggtatcgataagcttgatatcgaattcctgcagcccgggggatccactagttctagagcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaatcaaaaagttaaaattgtacgaatagattcaccacttcttaacaaatcaaacccttcattgattttctcgaatggcaatacatgtgtaattaaaggatcaagagcaaacttcttcgccataaagtcggcaacaagttttggaacactatccttgctcttaaaaccgccaaatatagctcccttccatgtacgaccgcttagcaacagcataggattcatcgacaaattttgtgaatcaggaggaacacctacgatcacactgactccatatgcctcttgacagcaggacaacgcagttaccatagtatcaagacggcctataacttcaaaagagaaatcaactccaccgtttgacatttcagtaaggacttcttgtattggtttcttataatcttgagggttaacacattcagtagccccgacctccttagcttttgcaaatttgtccttattgatgtctacacctataatcctcgctgcgcctgcagctttacaccccataataacgcttagtcctactcctcctaaaccgaatactgcacaagtcgaaccctgtgtaacctttgcaactttaactgcggaaccgtaaccggtggaaaatccgcaccctatcaagcaaactttttccagtggtgaagctgcatcgattttagcgacagatatctcgtccaccactgtgtattgggaaaatgtagaagtaccaaggaaatggtgtataggtttccctctgcatgtaaatctgcttgtaccatcctgcatagtacctctaggcatagacaaatcatttttaaggcagaaattaccctcaggatgtttgcagactctacacttaccacattgaggagtgaacagtgggatcactttatcaccaggacgaacagtggtaacaccttcacctatggattcaacgattccggcagcctcgtgtcccgcgattactggcaaaggagtaactagagtgccactcaccacatggtcgtcggatctacagattccggtggcaaccatcttgattctaacctcgtgtgcttttggtggcgctacttctacttcttctatgctaaacggctttttctcttcccacaaaactgccgctttacacttaataactttaccggctgttgacatcctcagctagctattgtaatatgtgtgtttgtttggattattaagaagaataattacaaaaaaaattacaaaggaaggtaattacaacagaattaagaaaggacaagaaggaggaagagaatcagttcattatttcttctttgttatataacaaacccaagtagcgatttggccatacattaaaagttgagaaccaccctccctggcaacagccacaactcgttaccattgttcatcacgatcatgaaactcgctgtcagctgaaatttcacctcagtggatctctctttttattcttcatcgttccactaacctttttccatcagctggcagggaacggaaagtggaatcccatttagcgagcttcctcttttcttcaagaaaagacgaagcttgtgtgtgggtgcgcgcgctagtatctttccacattaagaaatataccataaaggttacttagacatcactatggctatatatatatatatatatatatgtaacttagcaccatcgcgcgtgcatcactgcatgtgttaaccgaaaagtttggcgaacacttcaccgacacggtcatttagatctgtcgtctgcattgcacgtcccttagccttaaatcctaggcgggagcattctcgtgtaattgtgcagcctgcgtagcaactcaacatagcgtagtctacccagtttttcaagggtttatcgttagaagattctcccttttcttcctgctcacaaatcttaaagtcatacattgcacgactaaatgcaagcatgcggatcccccgggctgcaggaattcgatatcaagcttatcgataccgtcgactggccattaatctttcccatattagatttcgccaagccatgaaagttcaagaaaggtctttagacgaattacccttcatttctcaaactggcgtcaagggatcctggtatggttttatcgttttatttctggttcttatagcatcgttttggacttctctgttcccattaggcggttcaggagccagcgcagaatcattctttgaaggatacttatcctttccaattttgattgtctgttacgttggacataaactgtatactagaaattggactttgatggtgaaactagaagatatggatcttgataccggcagaaaacaagtagatttgactcttcgtagggaagaaatgaggattgagcgagaaacattagcaaaaagatccttcgtaacaagatttttacatttctggtgttgaagggaaagatatgagctatacagcggaatttccatatcactcagattttgttatctaattttttccttcccacgtccgcgggaatctgtgtatattactgcatctagatatatgttatcttatcttggcgcgtacatttaattttcaacgtattctataagaaattgcgggagtttttttcatgtagatgatactgactgcacgcaaatataggcatgatttataggcatgatttgatggctgtaccgataggaacgctaagagtaacttcagaatcgttatcctggcggaaaaaattcatttgtaaactttaaaaaaaaaagccaatatccccaaaattattaagagcgcctccattattaactaaaatttcactcagcatccacaatgtatcaggtatctactacagatattacatgtggcgaaaaagacaagaacaatgcaatagcgcatcaagaaaaaacacaaagctttcaatcaatgaatcgaaaatgtcattaaaatagtatataaattgaaactaagtcataaagctataaaaagaaaatttatttaaatgcaagatttaaagtaaattcacggccctgcaggcctcagctcttgttttgttctgcaaataacttacccatctttttcaaaactttaggtgcaccctcctttgctagaataagttctatccaatacatcctatttggatctgcttgagcttctttcatcacggatacgaattcattttctgttctcacaattttggacacaactctgtcttccgttgccccgaaactttctggcagttttgagtaattccacataggaatgtcattataactctggttcggaccatgaatttccctctcaaccgtgtaaccatcgttattaatgataaagcagattgggtttatcttctctctaatggctagtcctaattcttggacagtcagttgcaatgatccatctccgataaacaataaatgtctagattctttatctgcaatttggctgcctagagctgcggggaaagtgtatcctatagatccccacaagggttgaccaataaaatgtgatttcgatttcagaaatatagatgaggcaccgaagaaagaagtgccttgttcagccacgatcgtctcattactttgggtcaaattttcgacagcttgccacagtctatcttgtgacaacagcgcgttagaaggtacaaaatcttcttgctttttatctatgtacttgcctttatattcaatttcggacaagtcaagaagagatgatatcagggattcgaagtcgaaattttggattctttcgttgaaaattttaccttcatcgatattcaaggaaatcattttattttcattaagatggtgagtaaatgcacccgtactagaatcggtaagctttacacccaacataagaataaaatcagcagattccacaaattccttcaagtttggctctgacagagtaccgttgtaaatccccaaaaatgagggcaatgcttcatcaacagatgatttaccaaagttcaaagtagtaataggtaacttagtctttgaaataaactgagtaacagtcttctctaggccgaacgatataatttcatggcctgtgattacaattggtttcttggcattcttcagactttcctgtattttgttcagaatctcttgatcagatgtattcgacgtggaattttccttcttaagaggcaaggatggtttttcagccttagcggcagctacatctacaggtaaattgatgtaaaccggctttctttcctttagtaaggcagacaacactctatcaatttcaacagttgcattctcggctgtcaataaagtcctggcagcagtaaccggttcgtgcatcttcataaagtgcttgaaatcaccatcagccaacgtatggtgaacaaacttaccttcgttctgcactttcgaggtaggagatcccacgatctcaacaacaggcaggttctcagcataggagcccgctaagccattaactgcggataattcgccaacaccaaatgtagtcaagaatgccgcagcctttttcgttcttgcgtacccgtcggccatataggaggcatttaactcattagcatttcccacccatttcatatctttgtgtgaaataatttgatctagaaattgcaaattgtagtcacctggtactccgaatatttcttctatacctaattcgtgtaatctgtccaacagatagtcacctactgtatacattttgtttactagtttatgtgtgtttattcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaactgaaaaagcgtgttttttattcaaaatgattctaactcccttacgtaatcaaggaatctttttgccttggcctccgcgtcattaaacttcttgttgttgacgctaacattcaacgctagtatatattcgtttttttcaggtaagttcttttcaacgggtcttactgatgaggcagtcgcgtctgaacctgttaagaggtcaaatatgtcttcttgaccgtacgtgtcttgcatgttattagctttgggaatttgcatcaagtcataggaaaatttaaatcttggctctcttgggctcaaggtgacaaggtcctcgaaaatagggcgcgccccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 222 - DNA, 57 bp, Artificial Sequence
  T-kivD(A) primer
acacaatacaataacaagaagaacaaaatgtatacagtaggtgactatctgttggac

SEQ ID NO: 223 - DNA, 56 bp, Artificial Sequence
  B-kivD(B) primer
tcaggcagcgcctgcgttcgagtcagctcttgttttgttctgcaaataacttaccc

SEQ ID NO: 224 - DNA, 5231 bp, Artificial Sequence
  pUC19-URA3-sadB-PDC5fragmentB plasmid
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatccggcgcgccatgaaagctctggtttatcacggtgaccacaagatctcgcttgaagacaagcccaagcccacccttcaaaagcccacggatgtagtagtacgggttttgaagaccacgatctgcggcacggatctcggcatctacaaaggcaagaatccagaggtcgccgacgggcgcatcctgggccatgaaggggtaggcgtcatcgaggaagtgggcgagagtgtcacgcagttcaagaaaggcgacaaggtcctgatttcctgcgtcacttcttgcggctcgtgcgactactgcaagaagcagctttactcccattgccgcgacggcgggtggatcctgggttacatgatcgatggcgtgcaggccgaatacgtccgcatcccgcatgccgacaacagcctctacaagatcccccagacaattgacgacgaaatcgccgtcctgctgagcgacatcctgcccaccggccacgaaatcggcgtccagtatgggaatgtccagccgggcgatgcggtggctattgtcggcgcgggccccgtcggcatgtccgtactgttgaccgcccagttctactccccctcgaccatcatcgtgatcgacatggacgagaatcgcctccagctcgccaaggagctcggggcaacgcacaccatcaactccggcacggagaacgttgtcgaagccgtgcataggattgcggcagagggagtcgatgttgcgatcgaggcggtgggcataccggcgacttgggacatctgccaggagatcgtcaagcccggcgcgcacatcgccaacgtcggcgtgcatggcgtcaaggttgacttcgagattcagaagctctggatcaagaacctgacgatcaccacgggactggtgaacacgaacacgacgcccatgctgatgaaggtcgcctcgaccgacaagcttccgttgaagaagatgattacccatcgcttcgagctggccgagatcgagcacgcctatcaggtattcctcaatggcgccaaggagaaggcgatgaagatcatcctctcgaacgcaggcgctgcctgagctaattaacataaaactcatgattcaacgtttgtgtatttttttacttttgaaggttatagatgtttaggtaaataattggcatagatatagttttagtataataaatttctgatttggtttaaaatatcaactattttttttcacatatgttcttgtaattacttttctgtcctgtcttccaggttaaagattagcttctaatattttaggtggtttattatttaattttatgctgattaatttatttacttgtttaaacggccggccaatgtggctgtggtttcagggtccataaagcttttcaattcatcttttttttttttgttcttttttttgattccggtttctttgaaatttttttgattcggtaatctccgagcagaaggaagaacgaaggaaggagcacagacttagattggtatatatacgcatatgtggtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttctataatgacgaaaaaaaaaaaattggaaagaaaaagcttcatggccttgcggccgcttaattaatctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 225 - DNA, 47 bp, Artificial Sequence
  T-B(kivD) primer
atttgcagaacaaaacaagagctgactcgaacgcaggcgctgcctga

SEQ ID NO: 226 - DNA, 49 bp, Artificial Sequence
  oBP546 primer
agcgtatacatctgttgggaaagtagaaggccatgaagctttttctttc

SEQ ID NO: 227 - DNA, 49 bp, Artificial Sequence
  oBP547 primer
ttggaaagaaaaagcttcatggccttctactttcccaacagatgtatac

SEQ ID NO: 228 - DNA, 22 bp, Artificial Sequence
  oBP539 primer
ttattgtttagcgttagtagcg

SEQ ID NO: 229 - DNA, 21 bp, Artificial Sequence
  oBP540 primer
taggcataatcaccgaagaag

SEQ ID NO: 230 - DNA, 29 bp, Artificial Sequence
  kivD(652R) primer
ctgagtaacagtcttctctaggccgaacg

SEQ ID NO: 231 - DNA, 17 bp, Artificial Sequence
  oBP552 primer
agttgttagaactgttg

SEQ ID NO: 232 - DNA, 19 bp, Artificial Sequence
  oBP553 primer
gacgatagcgtatacatct

SEQ ID NO: 233 - DNA, 29 bp, Artificial Sequence
  kivD(602F) primer
caagagattctgaacaaaatacaggaaag

SEQ ID NO: 234 - DNA, 27 bp, Artificial Sequence
  kivD(1250F) primer
ccccgcagctctaggcagccaaattgc

SEQ ID NO: 235 - DNA, 9093 bp, Artificial Sequence
  pRS423-TPI1p-ilvD(y)  plasmid
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgaccctacgttagtgtgagcgggatttaaactgtgaggaccttaatacattcagacacttctgcggtatcaccctacttattcccttcgagattatatctaggaacccatcaggttggtggaagattacccgttctaagacttttcagcttcctctattgatgttacacctggacaccccttttctggcatccagtttttaatcttcagtggcatgtgagattctccgaaattaattaaagcaatcacacaattctctcggataccacctcggttgaaactgacaggtggtttgttacgcatgctaatgcaaaggagcctatatacctttggctcggctgctgtaacagggaatataaagggcagcataatttaggagtttagtgaacttgcaacatttactattttcccttcttacgtaaatatttttctttttaattctaaatcaatctttttcaattttttgtttgtattcttttcttgcttaaatctataactacaaaaaacacatacataaactaaaaactagtatggtacgtcctgtagaaaccccaacccgtgaaatcaaaaaactcgacggcctgtgggcattcagtctggatcgcgaaaactgtggaattgatcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatactccatttgaagccgatgtcacgccgtatgttattgccgggaaaagtgtacgtatcaccgtttgtgtgaacaacgaactgaactggcagactatcccgccgggaatggtgattaccgacgaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttgcgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaaggtgcacgggaatatttcgcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatgattaattaactagagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtca

SEQ ID NO: 236 - DNA, 4905 bp, Artificial Sequence
  pMOD-URA3r2 plasmid
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgacagctgtctcttatacacatctcaaccatcatcgatgaattttctcgggtgttctcgcatattggctcgaattcgcattgcggattacgtattctaatgttcaggtgctggaagaagagctgcttaaccgccgcgcccagggtgaagatccacgctactttaccctgcgtcgtctggatttcggcggctgtcgtctttcgctggcaacgccggttgatgaagcctgggacggtccgctctccttaaacggtaaacgtatcgccacctcttatcctcacctgctcaagcgttatctcgaccagaaaggcatctcttttaaatcctgcttactgaacggttctgttgaagtcgccccgcgtgccggactggcggatgcgatttgcgatctggtttccaccggtgccacgctggaagctaacggcctgcgcgaagtcgaagttatctatcgctcgaaagcctgcctgattcaacgcgatggcgaaatggaagaatccaaacagcaactgatcgacaaactgctgacccgtattcagggtgtgatccaggcgcgcgaatcaaaatacatcatgatgcacgcaccgaccgaacgtctggatgaagtcatggtacctactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatctctagagtgctggaagaagagctgcttaaccgccgcgcccagggtgaagatccacgctactttaccctgcgtcgtctggatttcggcggctgtcgtctttcgctggcaacgccggttgatgaagcctgggacggtccgctctccttaaacggtaaacgtatcgccacctcttatcctcacctgctcaagcgttatctcgaccagaaaggcatctcttttaaatcctgcttactgaacggttctgttgaagtcgccccgcgtgccggactggcggatgcgatttgcgatctggtttccaccggtgccacgctggaagctaacggcctgcgcgaagtcgaagttatctatcgctcgaaagcctgcctgattcaacgcgatggcgaaatggaagaatccaaacagcaactgatcgacaaactgctgacccgtattcagggtgtgatccaggcgcgcgaatcaaaatacatcatgatgcacgcaccgaccgaacgtctggatgaagtcatccagtgatgatacaacgagttagccaaggtgcggccgcgaattcgagctcggtacccggggatcctctagagtcgacctgcaggcatgcaagcttgccaacgactacgcactagccaacaagagcttcagggttgagatgtgtataagagacagctgtcttaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 237 - DNA, 56 bp, Artificial Sequence
  T-TEF1t(NotI) primer
ctaaagctatgtgcggccgcgtttaacttgatactactagattttttctcttcatt

SEQ ID NO: 238 - DNA, 52 bp, Artificial Sequence
  B-TEF1t(NotI) primer
ttacttatatggcggccgcgaacagagaaactaaatccacattaattgagag

SEQ ID NO: 239 - DNA, 60 bp, Artificial Sequence
  T-DSmo(RPS5p) primer
gagactagaaataaccgaccattccaaaatgaccgataaaaagactttgaaggatttgag

SEQ ID NO: 240 - DNA, 725 bp, Artificial Sequence
  UAS(PGK1)-FBA1p promoter
aattaccgtcgctcgtgatttgtttgcaaaaagaacaaaactgaaaaaacccagacacgctcgacttcctgtcttcctattgattgcagcttccaatttcgtcacacaacaaggtcctgtcgacgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaa

SEQ ID NO: 241 - DNA, 8366 bp, Artificial Sequence
  pRS316-UAS(PGK1)-FBA1p-GUS plasmid
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccacgcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaggggggatgtgctgcaaggcgattaagttgggtaacgccagggttttcccagtcacgacgttgtaaaacgacggccagtgaattgtaatacgactcactatagggcgaattggagctccaccgcggtggtttaacgtatagacttctaatatatttctccatacttggtattttttattcactttttttatacatatttggtttttttatacaatatcaaaaatcaataataattaatttaataacaagaatatgttgctgtgatgactcttaatatacaattgggaagcattcaaggattggtacgacgtttgctttctgataattaaacgcttggcgtttaatcttttttgccgattaataatattattattaccctcttatttattagcattgtcttccgtactaaaaggagtagggaaaaaggcgaagtagagtgacacgtccattacccagcgcttcataagaatccatcaggtatattaaattgtgatgggagaacaaaacaaattgtactatgatgtcgagaaattggtgaattctttgcaggaaagttttgacctggattgcgcgcaaagtgtatcacttttcaccagtaaatcaaggagcaatgaggcttggttggaagagctagagaataaattcaagttaaaagatgatgttgaacttgatgatgtggaaaatttaagagccgaaattgacatgaagttaaatatgttggaggataaagtaagctactatgaaagactttacaaagaactcgaagagttccagaatgaaataaaaattaaaacagttgtgaataacagaagacaatcgcgaactccaaaatgagctatcaaaaacgatagatcgattaggatgactttgaaatgactccgcagtggactggccgttaatttcaagcgtgagtaaaatagtgcatgacaaaagatgagctaggcttttgtaaaaatatcttacgttgtaaaattttagaaatcattatttccttcatatcattttgtcattgaccttcagaagaaaagagccgaccaataatataaataaataaataaaaataatattccattatttctaaacagattcaatactcattaaaaaactatatcaattaatttgaattaacgcggccgctctagttaattaatcattgtttgcctccctgctgcggtttttcaccgaagttcatgccagtccagcgtttttgcagcagaaaagccgccgacttcggtttgcggtcgcgagtgaagatccctttcttgttaccgccaacgcgcaatatgccttgcgaggtcgcaaaatcggcgaaattccatacctgttcaccgacgacggcgctgacgcgatcaaagacgcggtgatacatatccagccatgcacactgatactcttcactccacatgtcggtgtacattgagtgcagcccggctaacgtatccacgccgtattcggtgatgataatcggctgatgcagtttctcctgccaggccagaagttctttttccagtaccttctctgccgtttccaaatcgccgctttggacataccatccgtaataacggttcaggcacagcacatcaaagagatcgctgatggtatcggtgtgagcgtcgcagaacattacattgacgcaggtgatcggacgcgtcgggtcgagtttacgcgttgcttccgccagtggcgcgaaatattcccgtgcaccttgcggacgggtatccggttcgttggcaatactccacatcaccacgcttgggtggtttttgtcacgcgctatcagctctttaatcgcctgtaagtgcgcttgctgagtttccccgttgactgcctcttcgctgtacagttctttcggcttgttgcccgcttcgaaaccaatgcctaaagagaggttaaagccgacagcagcagtttcatcaatcaccacgatgccatgttcatctgcccagtcgagcatctcttcagcgtaagggtaatgcgaggtacggtaggagttggccccaatccagtccattaatgcgtggtcgtgcaccatcagcacgttatcgaatcctttgccacgcaagtccgcatcttcatgacgaccaaagccagtaaagtagaacggtttgtggttaatcaggaactgttcgcccttcactgccactgaccggatgccgacgcgaagcgggtagatatcacactctgtctggcttttggctgtgacgcacagttcatagagataaccttcacccggttgccagaggtgcggattcaccacttgcaaagtcccgctagtgccttgtccagttgcaaccacctgttgatccgcatcacgcagttcaacgctgacatcaccattggccaccacctgccagtcaacagacgcgtggttacagtcttgcgcgacatgcgtcaccacggtgatatcgtccacccaggtgttcggcgtggtgtagagcattacgctgcgatggattccggcatagttaaagaaatcatggaagtaagactgctttttcttgccgttttcgtcggtaatcaccattcccggcgggatagtctgccagttcagttcgttgttcacacaaacggtgatacgtacacttttcccggcaataacatacggcgtgacatcggcttcaaatggagtatagccgccctgatgctccatcacttcctgattattgacccacactttgccgtaatgagtgaccgcatcgaaacgcagcacgatacgctggcctgcccaacctttcggtataaagacttcgcgctgataccagacgttgcccgcataattacgaatatctgcatcggcgaactgatcgttaaaactgcctggcacagcaattgcccggctttcttgtaacgcgctttcccaccaacgctgatcaattccacagttttcgcgatccagactgaatgcccacaggccgtcgagttttttgatttcacgggttggggtttctacaggacgtaccatactagtttgaatatgtattacttggttatggttatatatgacaaaagaaaaagaagaacagaagaataacgcaaggaagaacaataactgaaattgatagagaagtattatgtctttgtctttttataataaatcaagtgcagaaatccgttagacaacatgagggataaaatttaacgtgggcgaagaagaaggaaaaaagtttttgtgagggcgtaattgaagcgatctgttgattgtagattttttttttttgaggagtcaaagtcagaagagaacagacaaatggtattaaccatccaatacttttttggagcaacgctaagctcatgcttttccattggttacgtgctcagttgttagatatggaaagagaggatgctcacggcagcgtgactccaattgagcccgaaagagaggatgccacgttttcccgacggctgctagaatggaaaaaggaaaaatagaagaatcccattcctatcattatttacgtaatgacccacacatttttgagattttcaactattacgtattacgataatcctgctgtcattatcattattatctatatcgacgtatgcaacgtatgtgaagccaagtaggcgtcgacaggaccttgttgtgtgacgaaattggaagctgcaatcaataggaagacaggaagtcgagcgtgtctgggttttttcagttttgttctttttgcaaacaaatcacgagcgacggtaattggtacccagcttttgttccctttagtgagggttaattccgagcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctcggcccccctgacgagcatcacaaaaatcgacgctcaagtcagaggtggcgaaacccgacaggactataaagataccaggcgttcccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactgcccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgaaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtc

SEQ ID NO: 242 - DNA, 49 bp, Artificial Sequence
  T-U/PGK1 (XhoApa)  primer
actacagatctcgaggggcccaattaccgtcgctcgtgatttgtttgca

SEQ ID NO: 243 - DNA, 49 bp, Artificial Sequence
  B-FBA1(SpeI) primer
gtatcaaatactagtttgaatatgtattacttggttatggttatatatg

SEQ ID NO: 244 - DNA, 7639 bp, Artificial Sequence
  pMOD-URA3r2-UAS(PGK1)-FBA1p-ilvD(y)-TEF1t plasmid
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgacagctgtctcttatacacatctcaaccatcatcgatgaattttctcgggtgttctcgcatattggctcgaattcgcattgcggattacgtattctaatgttcaggtgctggaagaagagctgcttaaccgccgcgcccagggtgaagatccacgctactttaccctgcgtcgtctggatttcggcggctgtcgtctttcgctggcaacgccggttgatgaagcctgggacggtccgctctccttaaacggtaaacgtatcgccacctcttatcctcacctgctcaagcgttatctcgaccagaaaggcatctcttttaaatcctgcttactgaacggttctgttgaagtcgccccgcgtgccggactggcggatgcgatttgcgatctggtttccaccggtgccacgctggaagctaacggcctgcgcgaagtcgaagttatctatcgctcgaaagcctgcctgattcaacgcgatggcgaaatggaagaatccaaacagcaactgatcgacaaactgctgacccgtattcagggtgtgatccaggcgcgcgaatcaaaatacatcatgatgcacgcaccgaccgaacgtctggatgaagtcatggtacctactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatctctagagtgctggaagaagagctgcttaaccgccgcgcccagggtgaagatccacgctactttaccctgcgtcgtctggatttcggcggctgtcgtctttcgctggcaacgccggttgatgaagcctgggacggtccgctctccttaaacggtaaacgtatcgccacctcttatcctcacctgctcaagcgttatctcgaccagaaaggcatctcttttaaatcctgcttactgaacggttctgttgaagtcgccccgcgtgccggactggcggatgcgatttgcgatctggtttccaccggtgccacgctggaagctaacggcctgcgcgaagtcgaagttatctatcgctcgaaagcctgcctgattcaacgcgatggcgaaatggaagaatccaaacagcaactgatcgacaaactgctgacccgtattcagggtgtgatccaggcgcgcgaatcaaaatacatcatgatgcacgcaccgaccgaacgtctggatgaagtcatccagtgatgatacaacgagttagccaaggtgcggccgccgaacagagaaactaaatccacattaattgagagttctatctattagaaaatgcaaactccaactaaatgggaaaacagataacctcttttatttttttttaatgtttgatattcgagtctttttcttttgttaggtttatattcatcatttcaatgaataaaagaagcttcttattttggttgcaaagaatgaaaaaaaaggattttttcatacttctaaagcttcaattataaccaaaaattttataaatgaagagaaaaaatctagtagtatcaagttaaacgcggccgcttaaccacagcaaccaggacaacattttttgccagtttcttcaggcttccaaaagtctgttacggctcccctagaagcagacgaaacgatgtgagcatatttaccaaggataccgcgtgaatagagcggtggcaattcaatggtctcttgacgatgttttaactcttcatcggagatatcaaagtgtaattccttagtgtcttggtcaatagtgactatgtctcctgtttgcaggtaggcgattggaccgccatcttgtgcttcaggagcgatatgacccacgacaagaccataagtaccacctgagaagcggccatctgtcagaagggcaactttttcaccttgccctttaccaacaatcattgatgaaagggaaagcatttcaggcataccaggaccgccctttggtcctacaaaacgtacgacaacaacatcaccatcaacaatatcatcattcaagacagcttcaatggcttcttcttcagaattaaagaccttagcaggaccgacatgacgacgcacttttacaccagaaactttggcaacggcaccgtctggagccaagttaccatggagaataatgagcggaccatcttcacgtttaggattttcaagcggcataataaccttttgaccaggtgttaaatcatcaaaagccttcaaattttcagcgactgttttgccagtacaagtgatacggtcaccatgaaggaagccatttttaaggagatatttcataactgctggtacccctccgaccttgtaaaggtcttggaatacatattgaccagaaggtttcaaatcagccaaatgaggaactttttcttggaaagtattgaaatcatcaagtgtcaattccacattagcagcatgggcaatagctaagaggtgaagggttgagttggttgaacctcccagagccatagttacagtaatagcatcttcaaaagcttcacgcgttaaaatgtcagaaggttttaagcccatttcgagcattttgacaacagcgcgaccagcttcttcaatatctgctttcttttctgcggattcagccgggtgagaagatgaacccggaaggctaagtcccaaaacttcaatagctgtcgccattgtgttagcagtatacataccaccgcagcctccaggaccgggacaagcattacattccaaagctttaacttcttctttggtcatatcgccgtggttccaatggccgacaccttcaaagacagagactaaatcgatatctttgccgtctaaattaccaggtgcaattgttccgccgtaagcaaaaatggctgggatatccatgttagccatagcgataacagaaccgggcatgtttttatcacaaccgccaatggctacaaaagcatccgcattatgacctcccatggctgcttcaatagaatctgcaataatatcacgagatgtcaaggagaaacgcattccttgggttcccatggcgattccatcagaaaccgtgattgttccgaactgaactggccaagcaccagcttccttaacaccgactttggctagtttaccaaagtcatgtaagtggatattacaaggtgtgttttcagcccaagttgaaatgacaccgacgataggtttttcaaagtcttcatcttgcataccagttgcacgcaacatagcacgattaggtgatttaaccattgaatcgtaaacagaactacgatttcttaagtctttaagagtttttttgtcagtcatactagtttgaatatgtattacttggttatggttatatatgacaaaagaaaaagaagaacagaagaataacgcaaggaagaacaataactgaaattgatagagaagtattatgtctttgtctttttataataaatcaagtgcagaaatccgttagacaacatgagggataaaatttaacgtgggcgaagaagaaggaaaaaagtttttgtgagggcgtaattgaagcgatctgttgattgtagattttttttttttgaggagtcaaagtcagaagagaacagacaaatggtattaaccatccaatacttttttggagcaacgctaagctcatgcttttccattggttacgtgctcagttgttagatatggaaagagaggatgctcacggcagcgtgactccaattgagcccgaaagagaggatgccacgttttcccgacggctgctagaatggaaaaaggaaaaatagaagaatcccattcctatcattatttacgtaatgacccacacatttttgagattttcaactattacgtattacgataatcctgctgtcattatcattattatctatatcgacgtatgcaacgtatgtgaagccaagtaggcgtcgacaggaccttgttgtgtgacgaaattggaagctgcaatcaataggaagacaggaagtcgagcgtgtctgggttttttcagttttgttctttttgcaaacaaatcacgagcgacggtaattgggcccctcgacctgcaggcatgcaagcttgccaacgactacgcactagccaacaagagcttcagggttgagatgtgtataagagacagctgtcttaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 245 - DNA, 77 bp, Artificial Sequence
  T-FRA(Dsm) primer
tcctaacaactcagtggagagaaacaaagcgccaacgacactataagatgcccgtaattaccgtcgctcgtgatttg

SEQ ID NO: 246 - DNA, 81 bp, Artificial Sequence
  B-FRA(Dsm)  primer
aaagattcaatgccgtctcctttcgaaacttaataatagaacaatatcatcctttcgcattgcggattacgtattctaatg

SEQ ID NO: 247 - DNA, 21 bp, Artificial Sequence
  oBP602 primer
tgttcaaacccctaaccaacc

SEQ ID NO: 248 - DNA, 27 bp, Artificial Sequence
  DSm(o)50R primer
ctgtttggggacttaaccattgaatcg

SEQ ID NO: 249 - DNA, 32 bp, Artificial Sequence
  DSm(o)1F primer
atgaccgataaaaagactttgaaggatttgag

SEQ ID NO: 250 - DNA, 26 bp, Artificial Sequence
  DSm(o)688F primer
gccaggttccagttctcatcctgctg

SEQ ID NO: 251 - DNA, 29 bp, Artificial Sequence
  DSm(o)1352F primer
gttggtcctaaaggtggtccaggtatgcc

SEQ ID NO: 252 - DNA, 4242 bp, Artificial Sequence
  pLA59 plasmid
aaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagaggatccgcaatgcggatccgcattgcggattacgtattctaatgttcagtaccgttcgtataatgtatgctatacgaagttatgcagattgtactgagagtgcaccataccaccttttcaattcatcattttttttttattcttttttttgatttcggtttccttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtataatgtatgctatacgaacggtaccagtgatgatacaacgagttagccaaggtgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaa

SEQ ID NO: 253 - DNA, 85 bp, Artificial Sequence
  T-URA(gpd_60bp) primer
gtattttggtagattcaattctctttccctttccttttccttcgctccccttctttatcagcattgcggattacgtattctaatg

SEQ ID NO: 254 - DNA, 55 bp, Artificial Sequence
  B-URA(alsS) primer
cagtattgttattcatttcagatccaccttggctaactcgttgtatcatcactgg

SEQ ID NO: 255 - DNA, 7589 bp, Artificial Sequence
  pUC19-kan::pdc1::FBA-alsS::TRX1 plasmid
tatttgtatcgaggtgtctagtcttctattacactaatgcagtttcagggttttggaaaccacactgtttaaacagtgttccttaatcaaggatacctctttttttttccttggttccactaattcatcggttttttttttggaagacatcttttccaacgaaaagaatatacatatcgtttaagagaaattctccaaatttgtaaagaagcggacccagacttaaggccgcccgcaaattaaagccttcgagcgtcccaaaaccttctcaagcaaggttttcagtataatgttacatgcgtacacgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatgattaattaactagagagctttcgttttcatgagttccccgaattctttcggaagcttgtcacttgctaaattaatgttatcactgtagtcaaccgggacatcgatgatgacaggaccttcagcgttcatgccttgacgcagaacatctgccagctggtctggtgattctacgcgcaagccagttgctccgaagctttccgcatatttcacgatatcgatatttccgaaatcgaccgcagatgtacggttatattttttcaattgctggaatgcaaccatgtcatatgtgctgtcgttccatacaatgtgtacaattggtgcttttagtcgaactgctgtctctaattccattgctgagaataagaaaccgccgtcaccagagacagaaaccactttttctcccggtttcaccaatgaagcgccgattgcccaaggaagcgcaacgccgagtgtttgcataccgttactgatcattaatgttaacggctcgtagctgcggaaataacgtgacatccaaatggcgtgcgaaccgatatcgcaagttactgtaacatgatcatcgactgcattacgcaactctttaacgatttcaagagggtgcgctctgtctgatttccaatctgcaggcacctgctcaccttcatgcatatattgttttaaatcagaaaggattttctgctcacgctctgcaaattccactttcacagcatcgtgttcgatatgattgatcgtggacggaatgtcaccgatcaattcaagatcaggctggtaagcatgatcaatgtcagcgataatctcgtctaaatggataattgtccggtctccattgatattccagaatttcggatcatattcaatcgggtcatagccgatcgtcagaacaacatctgcctgctctagcagtaaatcgccaggctggttgcggaacaaaccgatacggccaaaatattgatcctctaaatctctagaaagggtaccggcagcttgatatgtttcaacaaatggaagctgaacctttttcaaaagcttgcgaaccgctttaattgcttccggtcttccgcctttcatgccgaccaaaacgacaggaagttttgctgtttggatttttgctatggccgcactgattgcatcatctgctgcaggaccgagttttggcgctgcaacagcacgcacgtttttcgtatttgtgacttcattcacaacatcttgcggaaagctcacaaaagcggccccagcctgccctgctgacgctatcctaaatgcatttgtaacagcttccggtatattttttacatcttgaacttctacactgtattttgtaatcggctggaatagcgccgcattatccaaagattgatgtgtccgttttaaacgatctgcacggatcacgtttccagcaagcgcaacgacagggtctccttcagtgttcgctgtcagcaggcctgttgccaagttagaggcacccggtcctgatgtgactaacacgactcccggttttccagttaaacggccgactgcttgggccatgaatgctgcgttttgttcgtgccgggcaacgataatttcaggtcctttatcttgtaaagcgtcaaataccgcatcaatttttgcacctggaatgccaaatacatgtgtgacaccttgctccactaagcaatcaacaacaagctccgcccctctgtttttcacaagggatttttgttcttttgttgcttttgtcaacatcctcagctctagatttgaatatgtattacttggttatggttatatatgacaaaagaaaaagaagaacagaagaataacgcaaggaagaacaataactgaaattgatagagaagtattatgtctttgtctttttataataaatcaagtgcagaaatccgttagacaacatgagggataaaatttaacgtgggcgaagaagaaggaaaaaagtttttgtgagggcgtaattgaagcgatctgttgattgtagattttttttttttgaggagtcaaagtcagaagagaacagacaaatggtattaaccatccaatacttttttggagcaacgctaagctcatgcttttccattggttacgtgctcagttgttagatatggaaagagaggatgctcacggcagcgtgactccaattgagcccgaaagagaggatgccacgttttcccgacggctgctagaatggaaaaaggaaaaatagaagaatcccattcctatcattatttacgtaatgacccacacatttttgagattttcaactattacgtattacgataatcctgctgtcattatcattattatctatatcgacgtatgcaacgtatgtgaagccaagtaggcaattatttagtactgtcagtattgttattcatttcagatcttaagcctaaccaggccaattcaacagactgtcggcaacttcttgtctggtctttccatggtaagtgacagtgcagtaataatatgaaccaatttatttttcgttacataaaaatgcttataaaactttaactaataattagagattaaatcgcaaacggccgactctagaggatcccccaccttggctaactcgttgtatcatcactggataacttcgtatagcatacattatacgaagttatctagggattcataaccattttctcaatcgaattacacagaacacaccgtacaaacctctctatcataactacttaatagtcacacacgtactcgtctaaatacacatcatcgtcctacaagttcatcaaagtgttggacagacaactataccagcatggatctcttgtatcggttcttttctcccgctctctcgcaataacaatgaacactgggtcaatcatagcctacacaggtgaacagagtagcgtttatacagggtttatacggtgattcctacggcaaaaatttttcatttctaaaaaaaaaaagaaaaatttttctttccaacgctagaaggaaaagaaaaatctaattaaattgatttggtgattttctgagagttccctttttcatatatcgaattttgaatataaaaggagatcgaaaaaatttttctattcaatctgttttctggttttatttgatagtttttttgtgtattattattatggattagtactggtttatatgggtttttctgtataacttctttttattttagtttgtttaatcttattttgagttacattatagttccctaactgcaagagaagtaacattaaaactcgagatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaagtttaacttgatactactagattttttctcttcatttataaaatttttggttataattgaagctttagaagtatgaaaaaatccttttttttcattctttgcaaccaaaataagaagcttcttttattcattgaaatgatgaatataaacctaacaaaagaaaaagactcgaatatcaaacattaaaaaaaaataaaagaggttatctgttttcccatttagttggagtttgcattttctaatagatagaactctcaattaatgtggatttagtttctctgttcgataacttcgtatagcatacattatacgaagttatctgaacattagaatacgtaatccgcaatgcggggccgcttaattaatctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatccggcgcgccgttt

SEQ ID NO: 256 - DNA, 48 bp, Artificial Sequence
  T-alsS(URA) primer
tgatacaacgagttagccaaggtggatctgaaatgaataacaatactg

SEQ ID NO: 257 - DNA, 89 bp, Artificial Sequence
  B-alsS(gpd_60bp) primer
attggttgggggaaaaagaggcaacaggaaagatcagagggggagggggagggggggtgtctagagagctttcgttttcatgagttccc

SEQ ID NO: 258 - DNA, 23 bp, Artificial Sequence
  FBA-als1557 primer
ccgaaattctggaatatcaatgg

SEQ ID NO: 259 - DNA, 24 bp, Artificial Sequence
  gpd2-down178 primer
cgataatagcgtgtataatggtag

SEQ ID NO: 260 - DNA, 7555 bp, Artificial Sequence; identical to SEQ ID NO: 189
  pRS423: : Gal1-cre plasmid

SEQ ID NO: 261 - DNA, 33 bp, Artificial Sequence
  gpd2-up229 primer
gttcagcagctcttctctaccctgtcattctag

SEQ ID NO: 262 - DNA, 27 bp, Artificial Sequence
  FBA-als752 primer
gcttagtggagcaaggtgtcacacatg

SEQ ID NO: 263 - DNA, 10679 bp, Artificial Sequence
  pBP1339 (=pA-UAS(PGK1)-ENO2p-ilvD-TEF1t-ILV5p-adh-B-U-C) plasmid
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatccgcgatcgcaaagactacgagaatcaataaacgaggctaaactgcgtcacacatgattgtgattgagtactcacgttctcgtgttaatcccgcggtcttcttgttttactaacttttctttctctcatagcattctcttgacagtgttttatatacatcatatgtacatttatcgagccaatcgagggcagcagtttaacatcaagccggatttgctcacgctactttgaccccttttcgtttcgacggagagaagaaaccggtgttttcctatccttgcctattctttcctccttacggggtcctagcctgtttctcttgatatgataataggtggaaacgtagaaaaaaaaatcgacatataaaagtggggcagatacttcgtgtgacaatggccaattcaagccctttgggcagatgttgcccttcttctttcttaaaaagtcttagtacgattgaccaagtcagaaaaaaaaaaaaaaaggaactaaaaaaagttttaattaattatttaaatcgaacagagaaactaaatccacattaattgagagttctatctattagaaaatgcaaactccaactaaatgggaaaacagataacctcttttatttttttttaatgtttgatattcgagtctttttcttttgttaggtttatattcatcatttcaatgaataaaagaagcttcttattttggttgcaaagaatgaaaaaaaaggattttttcatacttctaaagcttcaattataaccaaaaattttataaatgaagagaaaaaatctagtagtatcaagttaaacgcggccgcttaaccacagcaaccaggacaacattttttgccagtttcttcaggcttccaaaagtctgttacggctcccctagaagcagacgaaacgatgtgagcatatttaccaaggataccgcgtgaatagagcggtggcaattcaatggtctcttgacgatgttttaactcttcatcggagatatcaaagtgtaattccttagtgtcttggtcaatagtgactatgtctcctgtttgcaggtaggcgattggaccgccatcttgtgcttcaggagcgatatgacccacgacaagaccataagtaccacctgagaagcggccatctgtcagaagggcaactttttcaccttgccctttaccaacaatcattgatgaaagggaaagcatttcaggcataccaggaccgccctttggtcctacaaaacgtacgacaacaacatcaccatcaacaatatcatcattcaagacagcttcaatggcttcttcttcagaattaaagaccttagcaggaccgacatgacgacgcacttttacaccagaaactttggcaacggcaccgtctggagccaagttaccatggagaataatgagcggaccatcttcacgtttaggattttcaagcggcataataaccttttgaccaggtgttaaatcatcaaaagccttcaaattttcagcgactgttttgccagtacaagtgatacggtcaccatgaaggaagccatttttaaggagatatttcataactgctggtacccctccgaccttgtaaaggtcttggaatacatattgaccagaaggtttcaaatcagccaaatgaggaactttttcttggaaagtattgaaatcatcaagtgtcaattccacattagcagcatgggcaatagctaagaggtgaagggttgagttggttgaacctcccagagccatagttacagtaatagcatcttcaaaagcttcacgcgttaaaatgtcagaaggttttaagcccatttcgagcattttgacaacagcgcgaccagcttcttcaatatctgctttcttttctgcggattcagccgggtgagaagatgaacccggaaggctaagtcccaaaacttcaatagctgtcgccattgtgttagcagtatacataccaccgcagcctccaggaccgggacaagcattacattccaaagctttaacttcttctttggtcatatcgccgtggttccaatggccgacaccttcaaagacagagactaaatcgatatctttgccgtctaaattaccaggtgcaattgttccgccgtaagcaaaaatggctgggatatccatgttagccatagcgataacagaaccgggcatgtttttatcacaaccgccaatggctacaaaagcatccgcattatgacctcccatggctgcttcaatagaatctgcaataatatcacgagatgtcaaggagaaacgcattccttgggttcccatggcgattccatcagaaaccgtgattgttccgaactgaactggccaagcaccagcttccttaacaccgactttggctagtttaccaaagtcatgtaagtggatattacaaggtgtgttttcagcccaagttgaaatgacaccgacgataggtttttcaaagtcttcatcttgcataccagttgcacgcaacatagcacgattaggtgatttaaccattgaatcgtaaacagaactacgatttcttaagtctttaagagtttttttgtcagtcatactagtattattgtatgttatagtattagttgcttggtgttatgaaagaaactaagaaaagaaaaataaaataaaaataaaagattgagacaagggaagaaaagatacaaaataagaattaattacaattgcgtttgctataaatacgtttttaacaatcaactctggtaggaagataatgctttttttttttatatatgcttggtgccacttgtcacatacaattctacaaccttcgacaaaaatccaaatgatagtaagatcaaagccagaaagcaatggagaaaaaaaattaatgaaccacgatgaaccaaatgatcaatacaaccaaagaaactaccctagtgaggtgtatgctgacttggtatcacacttcatgaattttgcatatggcaaagtccacgaaagtgggcttcagaaaaaaggcgtgcggtgtgtagatgtatcaattagtggatgccagttttggaacgggattccactttccgcaagttggtgcacgtcgttagtgacataacgccgcgtcgacaggaccttgttgtgtgacgaaattggaagctgcaatcaataggaagacaggaagtcgagcgtgtctgggttttttcagttttgttctttttgcaaacaaatcacgagcgacggtaattggcgcgccacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttatgaaagcattagtgtataggggcccaggccagaagttggtggaagagagacagaagccagagcttaaggaacctggtgacgctatagtgaaggtaacaaagactacaatttgcggaaccgatctacacattcttaaaggtgacgttgcgacttgtaaacccggtcgtgtattagggcatgaaggagtgggggttattgaatcagtcggatctggggttactgctttccaaccaggcgatagagttttgatatcatgtatatcgagttgcggaaagtgctcattttgtagaagaggaatgttcagtcactgtacgaccgggggttggattctgggcaacgaaattgatggtacccaagcagagtacgtaagagtaccacatgctgacacatccctttatcgtattccggcaggtgcggatgaagaggccttagtcatgttatcagatattctaccaacgggttttgagtgcggagtcctaaacggcaaagtcgcacctggttcttcggtggctatagtaggtgctggtcccgttggtttggccgccttactgacagcacaattctactccccagctgaaatcataatgatcgatcttgatgataacaggctgggattagccaaacaatttggtgccaccagaacagtaaactccacgggtggtaacgccgcagccgaagtgaaagctcttactgaaggcttaggtgttgatactgcgattgaagcagttgggatacctgctacatttgaattgtgtcagaatatcgtagctcccggtggaactatcgctaatgtcggcgttcacggtagcaaagttgatttgcatcttgaaagtttatggtcccataatgtcacgattactacaaggttggttgacacggctaccaccccgatgttactgaaaactgttcaaagtcacaagctagatccatctagattgataacacatagattcagcctggaccagatcttggacgcatatgaaacttttggccaagctgcgtctactcaagcactaaaagtcatcatttcgatggaggcttgattaattaagagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtgtttaaactgacaaaataatatttggggcccctcgcggctcatttgtagtatctaagattatgtattttcttttataatatttgttgttatgaaacagacagaagtaagtttctgcgactatattatttttttttttcttctttttttttcctttattcaacttggcgatgagctgaaaatttttttggttaaggaccctttagaagtattgaatgtgggaacaaagacgacaaaaggtagttttttccttgactatactggtaagatatcgtctaaaacaaagcatggccaagaaaatatcaaagaattcaagagctgctagacaatcggatgctcttgaaccagaggtaaaggatttaagtgaactacctagagctgaaaaaaccgatttgactaatattttgattagaacagcagccaagaatgaggcattgctggaagcaaagatatctaagaaagccaataaaagtaagaggggcaagaagttaaataaaaaggctctggaagggccggccaatgtggctgtggtttcagggtccataaagcttttcaattcatcttttttttttttgttcttttttttgattccggtttctttgaaatttttttgattcggtaatctccgagcagaaggaagaacgaaggaaggagcacagacttagattggtatatatacgcatatgtggtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttctataatgacgaaaaaaaaaaaattggaaagaaaaagcttcatggccttgcggccgcttgtagtgtctgaaattgcagagagaagaatagaaatggccaagaaactgggcgttgaggtgttcaatccctccaagcacggtcataaatctatagagatactacgtggtttgaccaagagccatgatgggtttgattacagttatgattgttctggtattcaagttactttcgaaacctctttgaaggcattaacattcaaggggacagccaccaacattgcagtttggggtccaaaacctgtcccattccaaccaatggatgtgactctccaagagaaagttatgactggttcgatcggctatgttgtcgaagccttcgaagaagttgttcgtgccatccacaacggagacatcgccatggaagattgtaagcaactaatcactggtaagcaaaggattgaggacggttgggaaaagggattccaagagttgatggatcacaaggaatccaacgttaagattctattgacgcctaacaatcacggtgaaatgaagtaattaattaatctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 264 - DNA, 40 bp, Artificial Sequence
  oBP685 primer
aattggatccgcgatcgcaaagactacgagaatcaataaa

SEQ ID NO: 265 - DNA, 34 bp, Artificial Sequence
  oBP690 primer
aattttaattaattacttcatttcaccgtgattg

SEQ ID NO: 266 - DNA, 22 bp, Artificial Sequence
  oBP726 primer
atcaagattattctgactccaa

SEQ ID NO: 267 - DNA, 33 bp, Artificial Sequence
  DSm1354F primer
cgggttcatcttctcacccggctgaatccgcag

SEQ ID NO: 268 - DNA, 26 bp, Artificial Sequence
  DSm788R primer
gcttcacgcgttaaaatgtcagaagg

SEQ ID NO: 269 - DNA, 33 bp, Artificial Sequence; identical to SEQ ID NO: 267
  DSm696F primer

SEQ ID NO: 270 - DNA, 26 bp, Artificial Sequence
  ADHBi643R primer
cggctgcggcgttaccacccgtggag

SEQ ID NO: 271 - DNA, 26 bp, Artificial Sequence
  ADHBi554F primer
cccgttggtttggccgccttactgac

SEQ ID NO: 272 - DNA, 23 bp, Artificial Sequence
  N1251 primer
ccaatgtggctgtggtttcaggg

SEQ ID NO: 273 - DNA, 26 bp, Artificial Sequence
  N1252 primer
gcaaggccatgaagctttttctttcc

SEQ ID NO: 274 - DNA, 57 bp, Artificial Sequence
  N1253 primer
gaaaaagcttcatggccttgcgctcatcaacactaaaattagagtcattctaattgc

SEQ ID NO: 275 - DNA, 29 bp, Artificial Sequence
  N1254 primer
ttatccacggaagatatgatgaggtgacg

SEQ ID NO: 276 - DNA, 29 bp, Artificial Sequence
  N1256 primer
acctagctaaactaagtaaatctgtatac

SEQ ID NO: 277 - DNA, 64 bp, Artificial Sequence
  N1255 primer
ggaccctgaaaccacagccacattggtaccttccttgccaaagggattaaacctgacaattacc

SEQ ID NO: 278 - DNA, 29 bp, Artificial Sequence
  N1257 primer
gatgatgctatttggtgcagagggtgatg

SEQ ID NO: 279 - DNA, 60 bp, Artificial Sequence
  N1258 primer
cagatttacttagtttagctaggtgtatcaaaatacgttctcaatgttctatttcccgcc

SEQ ID NO: 280 - DNA, 28 bp, Artificial Sequence
  N1249 primer
gctttatggaccctgaaaccacagccac

SEQ ID NO: 281 - DNA, 25 bp, Artificial Sequence
  N1239 primer
gacgaggataatgtgcatgaacggg

SEQ ID NO: 282 - DNA, 27 bp, Artificial Sequence
  N1250 primer
ggaaagaaaaagcttcatggccttgcg

SEQ ID NO: 283 - DNA, 24 bp, Artificial Sequence
  N1242 primer
gtttcgttgcgttggtggaatggc

SEQ ID NO: 284 - DNA, 12518 bp, Artificial Sequence
  pK9D3.OLE1p.IlvD plasmid
ttcaatgctatcatttcctttgatattggatcatatgcatagtaccgagaaactagaggatctcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgctaaggattggaaaagagctgaagaacaaggtttcgaagtctacaccgctgctgaagctgctaagaaggctgacatcattatgatcttgatcaacgatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactgaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctcgcgaactccaaaatgagctatcaaaaacgatagatcgattaggatgactttgaaatgactccgcagtggactggccgttaatttcaagcgtgagtaaaatagtgcatgacaaaagatgagctaggcttttgtaaaaatatcttacgttgtaaaattttagaaatcattatttccttcatatcattttgtcattgaccttcagaagaaaagagccgaccaataatataaataaataaataaaaataatattccattatttctaaacagattcaatactcattaaaaaactatatcaattaatttgaattaacgcggccgcttaaccacagcaaccaggacaacattttttgccagtttcttcaggcttccaaaagtctgttacggctcccctagaagcagacgaaacgatgtgagcatatttaccaaggataccgcgtgaatagagcggtggcaattcaatggtctcttgacgatgttttaactcttcatcggagatatcaaagtgtaattccttagtgtcttggtcaatagtgactatgtctcctgtttgcaggtaggcgattggaccgccatcttgtgcttcaggagcgatatgacccacgacaagaccataagtaccacctgagaagcggccatctgtcagaagggcaactttttcaccttgccctttaccaacaatcattgatgaaagggaaagcatttcaggcataccaggaccgccctttggtcctacaaaacgtacgacaacaacatcaccatcaacaatatcatcattcaagacagcttcaatggcttcttcttcagaattaaagaccttagcaggaccgacatgacgacgcacttttacaccagaaactttggcaacggcaccgtctggagccaagttaccatggagaataatgagcggaccatcttcacgtttaggattttcaagcggcataataaccttttgaccaggtgttaaatcatcaaaagccttcaaattttcagcgactgttttgccagtacaagtgatacggtcaccatgaaggaagccatttttaaggagatatttcataactgctggtacccctccgaccttgtaaaggtcttggaatacatattgaccagaaggtttcaaatcagccaaatgaggaactttttcttggaaagtattgaaatcatcaagtgtcaattccacattagcagcatgggcaatagctaagaggtgaagggttgagttggttgaacctcccagagccatagttacagtaatagcatcttcaaaagcttcacgcgttaaaatgtcagaaggttttaagcccatttcgagcattttgacaacagcgcgaccagcttcttcaatatctgctttcttttctgcggattcagccgggtgagaagatgaacccggaaggctaagtcccaaaacttcaatagctgtcgccattgtgttagcagtatacataccaccgcagcctccaggaccgggacaagcattacattccaaagctttaacttcttctttggtcatatcgccgtggttccaatggccgacaccttcaaagacagagactaaatcgatatctttgccgtctaaattaccaggtgcaattgttccgccgtaagcaaaaatggctgggatatccatgttagccatagcgataacagaaccgggcatgtttttatcacaaccgccaatggctacaaaagcatccgcattatgacctcccatggctgcttcaatagaatctgcaataatatcacgagatgtcaaggagaaacgcattccttgggttcccatggcgattccatcagaaaccgtgattgttccgaactgaactggccaagcaccagcttccttaacaccgactttggctagtttaccaaagtcatgtaagtggatattacaaggtgtgttttcagcccaagttgaaatgacaccgacgataggtttttcaaagtcttcatcttgcataccagttgcacgcaacatagcacgattaggtgatttaaccattgaatcgtaaacagaactacgatttcttaagtctttaagagtttttttgtcagtcatactcacgtgctttgttgtaatgttttagtgctgtttataatatgatcaccacaactatctattactatgatgttctattctacgtaatacaaaatataaacggaaacagaagtaggaaagatggaaatagaacaataaatgaatcaagatctgcccccatatatatatgtatatgctgatttgcaagactcgatgagccaggagccgatgatttgctgcatatattgttaactactattatttccacctttgtgtgccatccccatagccgtaacaatagggataggtgtgtctgagtgagcaagactcgtagaagcacacctggttgggcactagataaggtttgttgagtgttcaacgtccgaaagaaagctgccgactatgcgaagagaaccttaagccgttattacctctgcctgtcacaggcgatgtgatgctaacgaacagcaccagagccaagccaactggggcggtctgcagagaaggctgggatacccgaaatagctcgctcaacagctttttttcttctacggaagcccaccagataagcgcctttgttgggcccgctaaccccgggacatgcccgggctcggagttagtttttgcacggccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatcc

SEQ ID NO: 285 - DNA, 76 bp, Artificial Sequence
  oBB210 primer
gaaggagcacagacttagattggtatatatacgcatatgtagtgttgaaggtcctgttccctagcatgtacgtgag

SEQ ID NO: 286 - DNA, 80 bp, Artificial Sequence
  oBB211 primer
ccgagattcccgggtaataactgatataattaaattgaagctctaatttgtgaggaataccacttgccacctatcaccac

SEQ ID NO: 287 - DNA, 23 bp, Artificial Sequence
  AK109-1 primer
agtcacatcaagatcgtttatgg

SEQ ID NO: 288 - DNA, 23 bp, Artificial Sequence
  AK109-2 primer
gcacggaatatgggactacttcg

SEQ ID NO: 289 - DNA, 23 bp, Artificial Sequence
  AK109-3 primer
actccacttcaagtaagagtttg

SEQ ID NO: 290 - DNA, 24 bp, Artificial Sequence
  oBP452 primer
ttctcgacgtgggcctttttcttg

SEQ ID NO: 291 - DNA, 49 bp, Artificial Sequence
  oBP453 primer
tgcagctttaaataatcggtgtcactactttgccttcgtttatcttgcc

SEQ ID NO: 292 - DNA, 49 bp, Artificial Sequence
  oBP454 primer
gagcaggcaagataaacgaaggcaaagtagtgacaccgattatttaaag

SEQ ID NO: 293 - DNA, 49 bp, Artificial Sequence
  oBP455 primer
tatggaccctgaaaccacagccacattgtaaccaccacgacggttgttg

SEQ ID NO: 294 - DNA, 49 bp, Artificial Sequence
  oBP456 primer
tttagcaacaaccgtcgtggtggttacaatgtggctgtggtttcagggt

SEQ ID NO: 295 - DNA, 49 bp, Artificial Sequence
  oBP457 primer
ccagaaaccctatacctgtgtggacgtaaggccatgaagctttttcttt

SEQ ID NO: 296 - DNA, 49 bp, Artificial Sequence
  oBP458 primer
attggaaagaaaaagcttcatggccttacgtccacacaggtatagggtt

SEQ ID NO: 297 - DNA, 22 bp, Artificial Sequence
  oBP459 primer
cataagaacacctttggtggag

SEQ ID NO: 298 - DNA, 22 bp, Artificial Sequence
  oBP460 primer
aggattatcattcataagtttc

SEQ ID NO: 299 - DNA, 20 bp, Artificial Sequence
  LA135 primer
cttggcagcaacaggactag

SEQ ID NO: 300 - DNA, 23 bp, Artificial Sequence
  oBP461 primer
ttcttggagctgggacatgtttg

SEQ ID NO: 301 - DNA, 22 bp, Artificial Sequence
  LA92 primer
gagaagatgcggccagcaaaac

SEQ ID NO: 302 - DNA, 80 bp, Artificial Sequence
  LA678 primer
caacgttaacaccgttttcggtttgccaggtgacttcaacttgtccttgtgcattgcggattacgtattctaatgttcag

SEQ ID NO: 303 - DNA, 81 bp, Artificial Sequence
  LA679 primer
gtggagcatcgaagactggcaacatgatttcaatcattctgatcttagagcaccttggctaactcgttgtatcatcactgg

SEQ ID NO: 304 - DNA, 23 bp, Artificial Sequence
  LA337 primer
ctcatttgaatcagcttatggtg

SEQ ID NO: 305 - DNA, 24 bp, Artificial Sequence
  LA692 primer
ggaagtcattgacaccatcttggc

SEQ ID NO: 306 - DNA, 24 bp, Artificial Sequence
  LA693 primer
agaagctgggacagcagcgttagc

SEQ ID NO: 307 - DNA, 7523 bp, Artificial Sequence
  pLA34 plasmid
ccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtattagaagccgccgagcgggcgacagccctccgacggaagactctcctccgtgcgtcctcgtcttcaccggtcgcgttcctgaaacgcagatgtgcctcgcgccgcactgctccgaacaataaagattctacaatactagcttttatggttatgaagaggaaaaattggcagtaacctggccccacaaaccttcaaattaacgaatcaaattaacaaccataggatgataatgcgattagttttttagccttatttctggggtaattaatcagcgaagcgatgatttttgatctattaacagatatataaatggaaaagctgcataaccactttaactaatactttcaacattttcagtttgtattacttcttattcaaatgtcataaaagtatcaacaaaaaattgttaatatacctctatactttaacgtcaaggagaaaaatgtccaatttactgcccgtacaccaaaatttgcctgcattaccggtcgatgcaacgagtgatgaggttcgcaagaacctgatggacatgttcagggatcgccaggcgttttctgagcatacctggaaaatgcttctgtccgtttgccggtcgtgggcggcatggtgcaagttgaataaccggaaatggtttcccgcagaacctgaagatgttcgcgattatcttctatatcttcaggcgcgcggtctggcagtaaaaactatccagcaacatttgggccagctaaacatgcttcatcgtcggtccgggctgccacgaccaagtgacagcaatgctgtttcactggttatgcggcggatccgaaaagaaaacgttgatgccggtgaacgtgcaaaacaggctctagcgttcgaacgcactgatttcgaccaggttcgttcactcatggaaaatagcgatcgctgccaggatatacgtaatctggcatttctggggattgcttataacaccctgttacgtatagccgaaattgccaggatcagggttaaagatatctcacgtactgacggtgggagaatgttaatccatattggcagaacgaaaacgctggttagcaccgcaggtgtagagaaggcacttagcctgggggtaactaaactggtcgagcgatggatttccgtctctggtgtagctgatgatccgaataactacctgttttgccgggtcagaaaaaatggtgttgccgcgccatctgccaccagccagctatcaactcgcgccctggaagggatttttgaagcaactcatcgattgatttacggcgctaaggatgactctggtcagagatacctggcctggtctggacacagtgcccgtgtcggagccgcgcgagatatggcccgcgctggagtttcaataccggagatcatgcaagctggtggctggaccaatgtaaatattgtcatgaactatatccgtaacctggatagtgaaacaggggcaatggtgcgcctgctggaagatggcgattaggagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtccgccaccgcggtggagct

SEQ ID NO: 308 - DNA, 96 bp, Artificial Sequence
  LA722 plasmid
tgccaattatttacctaaacatctataaccttcaaaagtaaaaaaatacacaaacgttgaatcatcaccttggctaactcgttgtatcatcactgg

SEQ ID NO: 309 - DNA, 80 bp, Artificial Sequence
  LA733 primer
cataatcaatctcaaagagaacaacacaatacaataacaagaagaacaaagcattgcggattacgtattctaatgttcag

SEQ ID NO: 310 - DNA, 30 bp, Artificial Sequence
  LA453 primer
caccgaagaagaatgcaaaaatttcagctc

SEQ ID NO: 311 - DNA, 25 bp, Artificial Sequence
  LA694 primer
gctgaagttgttagaactgttgttg

SEQ ID NO: 312 - DNA, 21 bp, Artificial Sequence
  LA695 primer
tgttagctggagtagacttgg

SEQ ID NO: 313 - DNA, 22 bp, Artificial Sequence
  oBP594 primer
agctgtctcgtgttgtgggttt

SEQ ID NO: 314 - DNA, 49 bp, Artificial Sequence
  oBP595 primer
cttaataatagaacaatatcatcctttacgggcatcttatagtgtcgtt

SEQ ID NO: 315 - DNA, 49 bp, Artificial Sequence
  oBP596 primer
gcgccaacgacactataagatgcccgtaaaggatgatattgttctatta

SEQ ID NO: 316 - DNA, 49 bp, Artificial Sequence
  oBP597 primer
tatggaccctgaaaccacagccacattgcaacgacgacaatgccaaacc

SEQ ID NO: 317 - DNA, 49 bp, Artificial Sequence
  oBP598 primer
tccttggtttggcattgtcgtcgttgcaatgtggctgtggtttcagggt

SEQ ID NO: 318 - DNA, 49 bp, Artificial Sequence
  oBP599 primer
atcctctcgcggagtccctgttcagtaaaggccatgaagctttttcttt

SEQ ID NO: 319 - DNA, 49 bp, Artificial Sequence
  oBP600 primer
attggaaagaaaaagcttcatggcctttactgaacagggactccgcgag

SEQ ID NO: 320 - DNA, 22 bp, Artificial Sequence
  oBP601 primer
tcataccacaatcttagaccat

SEQ ID NO: 321 - DNA, 22 bp, Artificial Sequence
  oBP603 primer
tgttcccacaatctattaccta

SEQ ID NO: 322 - DNA, 31 bp, Artificial Sequence
  LA811 primer
aacgaagcatctgtgcttcattttgtagaac

SEQ ID NO: 323 - DNA, 59 bp, Artificial Sequence
  LA817 primer
cgatccacttgtatatttggatgaatttttgaggaattctgaaccagtcctaaaacgag

SEQ ID NO: 324 - DNA, 31 bp, Artificial Sequence
  LA812 primer
aacaaagatatgctattgaagtgcaagatgg

SEQ ID NO: 325 - DNA, 33 bp, Artificial Sequence
  LA818 primer
ctcaaaaattcatccaaatatacaagtggatcg

SEQ ID NO: 326 - DNA, 90 bp, Artificial Sequence
  LA512 primer
gtattttggtagattcaattctctttccctttccttttccttcgctccccttccttatcagcattgcggattacgtattctaatgttcag

SEQ ID NO: 327 - DNA, 90 bp, Artificial Sequence
  LA513 primer
ttggttgggggaaaaagaggcaacaggaaagatcagagggggagggggggggagagtgtcaccttggctaactcgttgtatcatcactgg

SEQ ID NO: 328 - DNA, 29 bp, Artificial Sequence
  LA516 primer
ctcgaaacaataagacgacgatggctctg

SEQ ID NO: 329 - DNA, 30 bp, Artificial Sequence
  LA514 primer
cactatctggtgcaaacttggcaccggaag

SEQ ID NO: 330 - DNA, 29 bp, Artificial Sequence
  LA515 primer
tgtttgtagccactcgtgaacttctctgc

SEQ ID NO: 331 - DNA, 6903 bp, Artificial Sequence
  pLA71 plasmid
aaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcgatctgaaatgaataacaatactgacagtagatctgaaatgaataacaatactgacagtactaaataattgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaatctagagctgaggatgttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctagttaattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttaggttttgggacgctcgaaggctttaatttggatccgcattgcggattacgtattctaatgttcagtaccgttcgtataatgtatgctatacgaagttatgcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtataatgtatgctatacgaacggtaccagtgatgatacaacgagttagccaaggtgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaa

SEQ ID NO: 332 - DNA, 96 bp, Artificial Sequence
  LA829 primer
ccaaatttacaatatctcctgaattcttggcttggaatatgggcagtacagcttgtgtgatattgcaccttggctaactcgttgtatcatcactgg

SEQ ID NO: 333 - DNA, 90 bp, Artificial Sequence
  LA834 primer
atgtcccaaggtagaaaagctgcagaaagattggctaagaagactgtcctcattacaggtgatctgaaatgaataacaatactgacagta

SEQ ID NO: 334 - DNA, 22 bp, Artificial Sequence
  LA740 primer
cgataatcctgctgtcattatc

SEQ ID NO: 335 - DNA, 29 bp, Artificial Sequence
  LA830 primer
cacggcaaacttagaggcacaatagatag

SEQ ID NO: 336 - DNA, 22 bp, Artificial Sequence
  LA92 primer
gagaagatgcggccagcaaaac

SEQ ID NO: 337 - DNA, 6924 bp, Artificial Sequence
  pLA78 plasmid
gatccgcattgcggattacgtattctaatgttcagtaccgttcgtataatgtatgctatacgaagttatgcagattgtactgagagtgcaccataccaccttttcaattcatcattttttttttattcttttttttgatttcggtttccttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtataatgtatgctatacgaacggtaccagtgatgatacaacgagttagccaaggtgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttccaattaccgtcgctcgtgatttgtttgcaaaaagaacaaaactgaaaaaacccagacacgctcgacttcctgtcttcctattgattgcagcttccaatttcgtcacacaacaaggtcctgtcgacgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaagtttaaacatgtataccgtaggacagtacttggtagatagactagaagagattggtatcgataaggttttcggtgtgccaggggattacaatttgacttttctagattacattcaaaatcacgaaggactttcctggcaagggaatactaatgaactaaacgcagcatatgcagcagatggctacgcccgtgaaagaggcgtatcagctcttgttactacattcggagtgggtgaactgtcagccattaacggaacagctggtagttttgcagaacaagtccctgtcatccacatcgtgggttctccaactatgaatgtgcaatccaacaaaaagctggttcatcattccttaggaatgggtaactttcataactttagtgaaatggctaaggaagtcactgccgctacaaccatgcttactgaagagaatgcagcttcagagatcgacagagtattagaaacagccttgttggaaaagaggccagtatacatcaatcttccaattgatatagctcataaagcaatagttaaacctgcaaaagcactacaaacagagaaatcatctggtgagagagaggcacaacttgcagaaatcatactatcacacttagaaaaggccgctcaacctatcgtaatcgccggtcatgagatcgcccgtttccagataagagaaagatttgaaaactggataaaccaaacaaagttgccagtaaccaatttggcatatggcaaaggctctttcaatgaagagaacgaacatttcattggtacctattacccagctttttctgacaaaaacgttctggattacgttgacaatagtgacttcgttttacattttggtgggaaaatcattgacaattctacctcctcattttctcaaggctttaagactgaaaacactttaaccgctgcaaatgacatcattatgctgccagatgggtctacttactctgggatttctcttaacggtcttttggcagagctggaaaaactaaactttacttttgctgatactgctgctaaacaagctgaattagctgttttcgaaccacaggccgaaacaccactaaagcaagacagatttcaccaagctgttatgaactttttgcaagctgatgatgtgttggtcactgagcaggggacatcatctttcggtttgatgttggcacctctgaaaaagggtatgaatttgatcagtcaaacattatggggctccataggatacacattacctgctatgattggttcacaaattgctgccccagaaaggagacacattctatccatcggtgatggatcttttcaactgacagcacaggaaatgtccaccatcttcagagagaaattgacaccagtgatattcattatcaataacgatggctatacagtcgaaagagccatccatggagaggatgagagttacaatgatataccaacttggaacttgcaattagttgctgaaacatttggtggtgatgccgaaactgtcgacactcacaacgttttcacagaaacagacttcgctaatactttagctgctatcgatgctactcctcaaaaagcacatgtcgttgaagttcatatggaacaaatggatatgccagaatcattgagacagattggcttagccttatctaagcaaaactcttaagtttaaactaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgttgtaatcgttcttccacacg

SEQ ID NO: 338 - DNA, 92 bp, Artificial Sequence
  LA850 primer
atgactaagctacactttgacactgctgaaccagtcaagatcacacttccaaatggtttgacataaattaccgtcgctcgtgatttgtttgc

SEQ ID NO: 339 - DNA, 94 bp, Artificial Sequence
  LA851 primer
ttacaacttaattctgacagcttttacttcagtgtatgcatggtagacttcttcacccatttccaccttggctaactcgttgtatcatcactgg

SEQ ID NO: 340 - DNA, 24 bp, Artificial Sequence
  N1262 primer
cacgtaagggcatgatagaattgg

SEQ ID NO: 341 - DNA, 26 bp, Artificial Sequence
  N1263 primer
ggatatagcagttgttgtacactagc

SEQ ID NO: 342 - DNA, 6761 bp, Artificial Sequence
  pLA65 plasmid
gatccgcattgcggattacgtattctaatgttcagtaccgttcgtataatgtatgctatacgaagttatgcagattgtactgagagtgcaccataccaccttttcaattcatcattttttttttattcttttttttgatttcggtttccttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtataatgtatgctatacgaacggtaccagtgatgatacaacgagttagccaaggtgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttatgaaagcattagtgtataggggcccaggccagaagttggtggaagagagacagaagccagagcttaaggaacctggtgacgctatagtgaaggtaacaaagactacaatttgcggaaccgatctacacattcttaaaggtgacgttgcgacttgtaaacccggtcgtgtattagggcatgaaggagtgggggttattgaatcagtcggatctggggttactgctttccaaccaggcgatagagttttgatatcatgtatatcgagttgcggaaagtgctcattttgtagaagaggaatgttcagtcactgtacgaccgggggttggattctgggcaacgaaattgatggtacccaagcagagtacgtaagagtaccacatgctgacacatccctttatcgtattccggcaggtgcggatgaagaggccttagtcatgttatcagatattctaccaacgggttttgagtgcggagtcctaaacggcaaagtcgcacctggttcttcggtggctatagtaggtgctggtcccgttggtttggccgccttactgacagcacaattctactccccagctgaaatcataatgatcgatcttgatgataacaggctgggattagccaaacaatttggtgccaccagaacagtaaactccacgggtggtaacgccgcagccgaagtgaaagctcttactgaaggcttaggtgttgatactgcgattgaagcagttgggatacctgctacatttgaattgtgtcagaatatcgtagctcccggtggaactatcgctaatgtcggcgttcacggtagcaaagttgatttgcatcttgaaagtttatggtcccataatgtcacgattactacaaggttggttgacacggctaccaccccgatgttactgaaaactgttcaaagtcacaagctagatccatctagattgataacacatagattcagcctggaccagatcttggacgcatatgaaacttttggccaagctgcgtctactcaagcactaaaagtcatcatttcgatggaggcttgattaattaagagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtg

SEQ ID NO: 343 - DNA, 80 bp, Artificial Sequence
  LA855 primer
gcacaatatttcaagctataccaagcatacaatcaactatctcatatacaacctggtaaaacctctagtggagtagtaga

SEQ ID NO: 344 - DNA, 83 bp, Artificial Sequence
  LA856 primer
gcttatttagaagtgtcaacaacgtatctaccaacgatttgacccttttccacaccttggctaactcgttgtatcatcactgg

SEQ ID NO: 345 - DNA, 25 bp, Artificial Sequence
  LA414 primer
ccagagctgatgaggggtatctcga

SEQ ID NO: 346 - DNA, 25 bp, Artificial Sequence
  LA749 primer
caagtcttttgtgccttcccgtcgg

SEQ ID NO: 347 - DNA, 25 bp, Artificial Sequence
  LA413 primer
ggacataaaatacacaccgagattc

SEQ ID NO: 348 - DNA, 90 bp, Artificial Sequence
  LA860 primer
tctcaattattattttctactcataacctcacgcaaaataacacagtcaaatcaatcaaaatgaaagcattagtgtataggggcccaggc

SEQ ID NO: 349 - DNA, 26 bp, Artificial Sequence
  N1093 primer
tttcaagatgcaaatcaactttgcta

SEQ ID NO: 350 - DNA, 20 bp, Artificial Sequence
  LA681 primer
ttattgcttagcgttggtag

SEQ ID NO: 351 - DNA, 12319 bp, Artificial Sequence
  pLH689 [pHR81-Ilv5p-K9JB4P.KARI-TEF(M7)p-IlvD.Strep] plasmid
tcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactgaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctcgcgaactccaaaatgagctatcaaaaacgatagatcgattaggatgactttgaaatgactccgcagtggactggccgttaatttcaagcgtgagtaaaatagtgcatgacaaaagatgagctaggcttttgtaaaaatatcttacgttgtaaaattttagaaatcattatttccttcatatcattttgtcattgaccttcagaagaaaagagccgaccaataatataaataaataaataaaaataatattccattatttctaaacagattcaatactcattaaaaaactatatcaattaatttgaattaacgcggccgcttaaccacagcaaccaggacaacattttttgccagtttcttcaggcttccaaaagtctgttacggctcccctagaagcagacgaaacgatgtgagcatatttaccaaggataccgcgtgaatagagcggtggcaattcaatggtctcttgacgatgttttaactcttcatcggagatatcaaagtgtaattccttagtgtcttggtcaatagtgactatgtctcctgtttgcaggtaggcgattggaccgccatcttgtgcttcaggagcgatatgacccacgacaagaccataagtaccacctgagaagcggccatctgtcagaagggcaactttttcaccttgccctttaccaacaatcattgatgaaagggaaagcatttcaggcataccaggaccgccctttggtcctacaaaacgtacgacaacaacatcaccatcaacaatatcatcattcaagacagcttcaatggcttcttcttcagaattaaagaccttagcaggaccgacatgacgacgcacttttacaccagaaactttggcaacggcaccgtctggagccaagttaccatggagaataatgagcggaccatcttcacgtttaggattttcaagcggcataataaccttttgaccaggtgttaaatcatcaaaagccttcaaattttcagcgactgttttgccagtacaagtgatacggtcaccatgaaggaagccatttttaaggagatatttcataactgctggtacccctccgaccttgtaaaggtcttggaatacatattgaccagaaggtttcaaatcagccaaatgaggaactttttcttggaaagtattgaaatcatcaagtgtcaattccacattagcagcatgggcaatagctaagaggtgaagggttgagttggttgaacctcccagagccatagttacagtaatagcatcttcaaaagcttcacgcgttaaaatgtcagaaggttttaagcccatttcgagcattttgacaacagcgcgaccagcttcttcaatatctgctttcttttctgcggattcagccgggtgagaagatgaacccggaaggctaagtcccaaaacttcaatagctgtcgccattgtgttagcagtatacataccaccgcagcctccaggaccgggacaagcattacattccaaagctttaacttcttctttggtcatatcgccgtggttccaatggccgacaccttcaaagacagagactaaatcgatatctttgccgtctaaattaccaggtgcaattgttccgccgtaagcaaaaatggctgggatatccatgttagccatagcgataacagaaccgggcatgtttttatcacaaccgccaatggctacaaaagcatccgcattatgacctcccatggctgcttcaatagaatctgcaataatatcacgagatgtcaaggagaaacgcattccttgggttcccatggcgattccatcagaaaccgtgattgttccgaactgaactggccaagcaccagcttccttaacaccgactttggctagtttaccaaagtcatgtaagtggatattacaaggtgtgttttcagcccaagttgaaatgacaccgacgataggtttttcaaagtcttcatcttgcataccagttgcacgcaacatagcacgattaggtgatttaaccattgaatcgtaaacagaactacgatttcttaagtctttaagagtttttttgtcagtcatactcacgtgaaacttagattagattgctatgctttctttccaatgagcaagaagtaaaaaaagttgtaatagaacaggaaaaatgaagctgaaacttgagaaattgaagaccgtttgttaactcaaatatcaatgggaggtcgtcgaaagagaacaaaatcgaaaaaaaagttttcaagagaaagaaacgtgataaaaatttttattgccttctccgacgaagaaaaagggacgaggcggtctctttttccttttccaaacctttagtacgggtaattaacggcaccctagaggaaggaggagggggaatttagtatgctgtgcttgggtgttttgaagtggtacggcggtgcgcggagtccgagaaaatctggaagagtaaaaaaggagtagagacattttgaagctatgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatc

SEQ ID NO: 352 - protein, 343 aa, Anaerostipes caccae
MEECKMAKIYYQEDCNLSLLDGKTIAVIGYGSQGHAHALNAKESGCNVIIGLYEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 353 - DNA, 1032 bp, Anaerostipes caccae
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactga

SEQ ID NO: 354 - DNA, 6005 bp, Artificial Sequence
  pBP2642 plasmid
tcgcgcgtttcggtgatgacggtgaaaacctctgacacatgcagctcccggagacggtcacagcttgtctgtaagcggatgccgggagcagacaagcccgtcagggcgcgtcagcgcgtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacgcggccgcggcgcgccgcttgcatttagtcgtgcaatgtatgactttaagatttgtgagcaggaagaaaagggagaatcttctaacgataaacccttgaaaaactgggtagactacgctatgttgagttgctacgcaggctgcacaattacacgagaatgctcccgcctaggatttaaggctaagggacgtgcaatgcagacgacagatctaaatgaccgtgtcggtgaagtgttcgccaaacttttcggttaacacatgcagtgatgcacgcgcgatggtgctaagttacatatatatatatatatatatagccatagtgatgtctaagtaacctttatggtatatttcttaatgtggaaagatactagcgcgcgcacccacacacaagcttcgtcttttcttgaagaaaagaggaagctcgctaaatgggattccactttccgttccctgccagctgatggaaaaaggttagtggaacgatgaagaataaaaagagagatccactgaggtgaaatttcagctgacagcgagtttcatgatcgtgatgaacaatggtaacgagttgtggctgttgccagggagggtggttctcaacttttaatgtatggccaaatcgctacttgggtttgttatataacaaagaagaaataatgaactgattctcttcctccttcttgtcctttcttaattctgttgtaattaccttcctttgtaattttttttgtaattattcttcttaataatccaaacaaacacacatattacaatagtttaaacttaattaagagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtcgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtc

SEQ ID NO: 355 - DNA, 315 bp, Saccharomyces cerevisiae
atggtcactcaattaaaatccgcttctgaatacgacagtgctttagcatctagcgacaagttagtcgttgttgacttttttgccacatggtgtgggccatgtaaaatgattgcaccaatgattgaaaagtttgcagaacaatattctgatgctgctttttacaagttggatgttgatgaagtctcagatgttgctcaaaaagctgaagtttcttccatgcctaccctgatcttctacaagggcggtaaggaggttaccagagtcgtcggtgccaacccagctgctatcaagcaagctattgcttccaacgtatag

SEQ ID NO: 356 - DNA, 45 bp, Artificial Sequence
  OT1666 primer
agatcactagtttaaacatggtcactcaattaaaatccgcttctg

SEQ ID NO: 357 - DNA, 55 bp, Artificial Sequence
  OT1667 primer
ctcgagggcctgcagggccttaattaactatacgttggaagcaatagcttgcttg

SEQ ID NO: 358 - DNA, 6320 bp, Artificial Sequence
  pRS413-GPM1-TRX2 plasmid
tcgcgcgtttcggtgatgacggtgaaaacctctgacacatgcagctcccggagacggtcacagcttgtctgtaagcggatgccgggagcagacaagcccgtcagggcgcgtcagcgcgtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacgcggccgcggcgcgccgcttgcatttagtcgtgcaatgtatgactttaagatttgtgagcaggaagaaaagggagaatcttctaacgataaacccttgaaaaactgggtagactacgctatgttgagttgctacgcaggctgcacaattacacgagaatgctcccgcctaggatttaaggctaagggacgtgcaatgcagacgacagatctaaatgaccgtgtcggtgaagtgttcgccaaacttttcggttaacacatgcagtgatgcacgcgcgatggtgctaagttacatatatatatatatatatatagccatagtgatgtctaagtaacctttatggtatatttcttaatgtggaaagatactagcgcgcgcacccacacacaagcttcgtcttttcttgaagaaaagaggaagctcgctaaatgggattccactttccgttccctgccagctgatggaaaaaggttagtggaacgatgaagaataaaaagagagatccactgaggtgaaatttcagctgacagcgagtttcatgatcgtgatgaacaatggtaacgagttgtggctgttgccagggagggtggttctcaacttttaatgtatggccaaatcgctacttgggtttgttatataacaaagaagaaataatgaactgattctcttcctccttcttgtcctttcttaattctgttgtaattaccttcctttgtaattttttttgtaattattcttcttaataatccaaacaaacacacatattacaatagtttaaacatggtcactcaattaaaatccgcttctgaatacgacagtgctttagcatctagcgacaagttagtcgttgttgacttttttgccacatggtgtgggccatgtaaaatgattgcaccaatgattgaaaagtttgcagaacaatattctgatgctgctttttacaagttggatgttgatgaagtctcagatgttgctcaaaaagctgaagtttcttccatgcctaccctgatcttctacaagggcggtaaggaggttaccagagtcgtcggtgccaacccagctgctatcaagcaagctattgcttccaacgtatagttaattaagagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtcgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtc

SEQ ID NO: 359 - DNA, 49 bp, Artificial Sequence
  OT1656 primer
cagatcactagtttaaacatggaaccaattgatgacttactttttgagg

SEQ ID NO: 360 - DNA, 61 bp, Artificial Sequence
  OT1657 primer
actcgagggcctgcagggccttaattaatcattttataccagtaaaatagtcatttagaga

SEQ ID NO: 361 - DNA, 8030 bp, Artificial Sequence
  pRS413-GPM1-YBP1 plasmid
tcgcgcgtttcggtgatgacggtgaaaacctctgacacatgcagctcccggagacggtcacagcttgtctgtaagcggatgccgggagcagacaagcccgtcagggcgcgtcagcgcgtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacgcggccgcggcgcgccgcttgcatttagtcgtgcaatgtatgactttaagatttgtgagcaggaagaaaagggagaatcttctaacgataaacccttgaaaaactgggtagactacgctatgttgagttgctacgcaggctgcacaattacacgagaatgctcccgcctaggatttaaggctaagggacgtgcaatgcagacgacagatctaaatgaccgtgtcggtgaagtgttcgccaaacttttcggttaacacatgcagtgatgcacgcgcgatggtgctaagttacatatatatatatatatatatagccatagtgatgtctaagtaacctttatggtatatttcttaatgtggaaagatactagcgcgcgcacccacacacaagcttcgtcttttcttgaagaaaagaggaagctcgctaaatgggattccactttccgttccctgccagctgatggaaaaaggttagtggaacgatgaagaataaaaagagagatccactgaggtgaaatttcagctgacagcgagtttcatgatcgtgatgaacaatggtaacgagttgtggctgttgccagggagggtggttctcaacttttaatgtatggccaaatcgctacttgggtttgttatataacaaagaagaaataatgaactgattctcttcctccttcttgtcctttcttaattctgttgtaattaccttcctttgtaattttttttgtaattattcttcttaataatccaaacaaacacacatattacaatagtttaaacatggaaccaattgatgacttactttttgaggttactgatgcgttcaaaactcagaaggaggatcttcttgagttggtaacattgattgatatatatggcgagcaagttaaccaagaggggagctatgaagaaaagacgagattcattgaaactttgaatacattgttagaggataatccgagtactactggtgaaatcggttgggatctgcctaagggattattgaagttcttgtcaaaggataatgtcgatgtaaatggaagactaggtacgaatatgattgtccaaggtgtaatgaagtgtttctatgccatctcaatccaaggcgagcccaaaaaatgtttaattactgggttggagttgctttcatccctttgttcaaaagatttttccaagagtgatcaacagaataaggaagactttgttgataaaaaggccaatacgttacctcctgaaggagtgatcgaaaattcctctaatcgaaaagattttccatcctacggtgaaagcaagagttcaaatgaatttttcttgaagttgaaatcctacattttatttgaattcataggggcgagtctgaaaaggatttctactctgtttccttcgaaatatctgggagctgctgtgtcaacaattgagaaatttgtgtatagtcatgcggacacttttgaagatgcccttttccttcttcgtagggtgtacacattctgcaggaactatattccccctgatccaccaaaagatatacaattgaacgaagattttactcgagagatgtttgataaagttgtggaggaagaaagtgaattacaggttagactattgcgtaggctttgtacttttggtatttcgacacccataaaaactgtcaccaccaatgccgacgtgaaatactattgtgcactaaatcaacagaagtttgaattatctgcatattacaccgaatatcttgagctattttgcaggtattaccaaatggcgttctcgcttgatgttgatatagagggagaatttcagaatgtgataaaagaatgtaggattatttataagtctgtaccccaggagatttctgctgttaatgatgaagcgaagttggttttggaaagaatggtatataaattggcttatacattcgaagtacaaaaggccgctaaagaaaaaaatgttggtttggactataatggtgtaatattattttctggtatccactatttggaaaccaatcaacatttagtaaaggaaatgaatataacggatgccatttatctctacttgagatttacaactccatcattatattctaaagtttactataatgtagcagttgaatcagttagtcgctactggctatggtatgccattacaaccgagcccttggaggatgtaaaaaaagaattgaagaatctttcagtgtttgttacaaaaacattattgcatgttctacttcaaaagaactgtattcaggtcaatcagcagttaagaatgataactttcactcttctcaccagattactatgtttaatacctgaaaaagttgcatttgagtttatcttagatgtgcttaagacatctccccttccattggctaagacgtccgtattatgtgtttttaaagacctttcaaggcgacgcatctccaccaaggataacgattctgagacggatttgattgtcgaaaaattatccaaactgaaggtcaatgatagtaacaaagctcagcaaagtaacatcagacattatatccaactagattcttccaaaatgaaagctgttcatgactgttgtctgcagactatccaagattcatttacggcagatgccaagaagagtgatatattattactgctaacttacttgaatattttcattgtgctaaaaaaaacatgggatgaagatctactgaagattgtttgttcgaagattgattctaatttgaagtcagtcgaacctgataaacttccgaagtataaggaaattgtggataaaaacgaatctctaaatgactattttactggtataaaatgattaattaagagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtcgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtc

SEQ ID NO: 362 - DNA, 43 bp, Artificial Sequence
  OT1595 primer
gatcactagtttaaacaatgagtgtgtctaccgccaagaggtc

SEQ ID NO: 363 - DNA, 60 bp, Artificial Sequence
  OT1596 primer
tgagccactcgagggcctgcagggccttagttcatatgcttattcaaagctaattgaacg

SEQ ID NO: 364 - DNA, 7935 bp, Artificial Sequence
  pRS413-GPM1-YAP1 plasmid
tcgcgcgtttcggtgatgacggtgaaaacctctgacacatgcagctcccggagacggtcacagcttgtctgtaagcggatgccgggagcagacaagcccgtcagggcgcgtcagcgcgtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacgcggccgcggcgcgccgcttgcatttagtcgtgcaatgtatgactttaagatttgtgagcaggaagaaaagggagaatcttctaacgataaacccttgaaaaactgggtagactacgctatgttgagttgctacgcaggctgcacaattacacgagaatgctcccgcctaggatttaaggctaagggacgtgcaatgcagacgacagatctaaatgaccgtgtcggtgaagtgttcgccaaacttttcggttaacacatgcagtgatgcacgcgcgatggtgctaagttacatatatatatatatatatatagccatagtgatgtctaagtaacctttatggtatatttcttaatgtggaaagatactagcgcgcgcacccacacacaagcttcgtcttttcttgaagaaaagaggaagctcgctaaatgggattccactttccgttccctgccagctgatggaaaaaggttagtggaacgatgaagaataaaaagagagatccactgaggtgaaatttcagctgacagcgagtttcatgatcgtgatgaacaatggtaacgagttgtggctgttgccagggagggtggttctcaacttttaatgtatggccaaatcgctacttgggtttgttatataacaaagaagaaataatgaactgattctcttcctccttcttgtcctttcttaattctgttgtaattaccttcctttgtaattttttttgtaattattcttcttaataatccaaacaaacacacatattacaatagtttaaacatgagtgtgtctaccgccaagaggtcgctggatgtcgtttctccgggttcattagcggagtttgagggttcaaaatctcgtcacgatgaaatagaaaatgaacatagacgtactagtacacgtgatggcgaggatagcgagcaaccgaagaagaagggtagcaaaactagcaaaaagcaagatttggatcctgaaactaagcagaagaggactgcccaaaatcgggccgctcaaagagcttttagggaacgtaaggagaggaagatgaaggaattggagaagaaggtacaaagtttagagagtattcagcagcaaaatgaagtggaagctacttttttgagggaccagttaatcactctggtgaatgagttaaaaaaatatagaccagagacaagaaatgactcaaaagtgctggaatatttagcaaggcgagatcctaatttgcatttttcaaaaaataacgttaaccacagcaatagcgagccaattgacacacccaatgatgacatacaagaaaatgttaaacaaaagatgaatttcacgtttcaatatccgcttgataacgacaacgacaacgactacagtaaaaatgtggggaaacaattaccttcaccaaatgatccaagtcattcggctcctatgcctataaatcagacacaaaagaaattaagtgacgctacagattcctccagcgctactttggattccctttcaaatagtaacgatgttcttaataacacaccaaactcctccacttcgatggattggttagataatgtaatatatactaacaggtttgtgtcaggtgatgatggcagcaatagtaaaactaagaatttagacagtaatatgttttctaatgactttaattttgaaaaccaatttgatgaacaagtttcggagttttgttcgaaaatgaaccaggtatgtggaacaaggcaatgtcccattcccaagaaacccatctcggctcttgataaagaagttttcgcgtcatcttctatactaagttcaaattctcctgctttaacaaatacttgggaatcacattctaatattacagataatactcctgctaatgtcactgctactgatgctactaaatatgaaaattccttctccggttttggccgacttggtttcgatatgagtgccaatcattacgtcgtgaatgataatagcactggtagcactgatagcactggtagcactgatagcactggtagcactggcaataagaacaaaaagaacaataataatagcgatgatgtactcccattcatatccgagtcaccgtttgatatgaaccaagttactaatttttttagtccgggatctaccggcatcggcaataatgctgcctctaacaccaatcccagcctactgcaaagcagcaaagaggatataccttttatcaacgcaaatctggctttcccagacgacaattcaactaatattcaattacaacctttctctgaatctcaatctcaaaataagtctgactacgacatgttttttagagattcatcgaaggaaggtaacaatttatttggagagtttttagaggatgacgatgatgacaaaaaagccgctaatatgtcagacgatgagtcaagtttaatcaagaaccagttaattaacgaagaaccagagcttccgaaacaatatctacaatcggtaccaggaaatgaaagcgaaatctcacaaaaaaatggcagtagtttacagaatgctgacaagatcaataatggtaatgataacgataatgataatgatgtcgttccatctaaggaaggctctttactaaggtgttcggaaatttgggatagaataacaacacatccgaaatactcagatattgatgtcgatggtttatgttccgagctaatggcaaaggcaaaatgttcagaaagaggggttgtcatcaatgcagaagacgttcaattagctttgaataagcatatgaactaaggccctgcaggccctcgagtggctcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgcaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtc

SEQ ID NO: 365 - DNA, 18 bp, Artificial Sequence
  Repeat insertion
actctaccggttctaccg

SEQ ID NO: 366 - DNA, 30 bp, Artificial Sequence
  OT1713 primer
gtgctatcagtgctaccagtgctatcagtg

SEQ ID NO: 367 - DNA, 100 bp, Artificial Sequence
  OT1695 primer
cactgatagcactggtagcactgatagcactggtagcactgactctaccggttctaccggcaataagaacaaaaagaacaataataatagcgatgatgta

SEQ ID NO: 368 - protein, 650 aa, Saccharomyces cerevisiae; identical to SEQ ID NO: 11

What is claimed is:

1. A recombinant yeast host cell comprising a modified polypeptide having yeast activator protein activity, wherein the modified polypeptide having yeast activator protein activity is Yap 1 and wherein the polypeptide comprises one or more amino acid substitutions corresponding to residues 411, 584, and 636 of SEQ ID NO: 11 and the polypeptide comprises an insertion of one or more tripeptide repeat units selected from Ser-Thr-Asp and Ser-Asp-Gly.

2. The recombinant yeast host cell of claim 1, wherein the polypeptide further comprises one or more amino acid substitutions corresponding to residues 80, 132, 168, 237, 254, 257, 297, 302, 367, 404, 444, 487, 498, 499, 548, or 617 of SEQ ID NO: 11.

3. The recombinant yeast host cell of claim 1, wherein the polypeptide encoded by the nucleotide sequence in the recombinant yeast host cell comprises SEQ ID NO: 24.

4. The recombinant yeast host cell of claim 1, wherein the recombinant yeast host cell further comprises a butanol biosynthetic pathway.

5. The recombinant yeast host cell of claim 4, wherein the butanol biosynthetic pathway is an isobutanol biosynthetic pathway.

6. The recombinant yeast host cell of claim 4, wherein the recombinant yeast host cell further comprises a deletion in an endogenous polynucleotide encoding a polypeptide having pyruvate decarboxylase activity.

7. The recombinant yeast host cell of claim 6, wherein the polypeptide having pyruvate decarboxylase activity is selected from the group consisting of: PDC1, PDC5, PDC6, and combinations thereof.

8. The recombinant yeast host cell of claim 1, wherein the recombinant yeast host cell is a member of a genus of yeast selected from the group consisting of: Saccharomyces, Schizosaccharomyces, Hansenula, Candida, Kluyveromyces, Yarrowia, Issatchenkia, and Pichia.

9. A composition comprising the recombinant yeast host cell of claim 1.

10. The recombinant yeast host cell of claim 1, wherein the one or more amino acid substitutions are N411S, D584G, or I636V.

11. The recombinant yeast host cell of claim 5, wherein the isobutanol biosynthetic pathway comprises the following substrate to product conversions:

a) pyruvate to acetolactate;
b) acetolactate to 2,3-dihydroxyisovalerate;

c) 2,3-dihydroxyisovalerate to α-ketoisovalerate;
d) α-ketoisovalerate to isobutyraldehyde; and
e) isobutyraldehyde to isobutanol.

12. A process for producing an alcohol comprising
  (a) providing the recombinant host cell of claim 1, wherein the host cell produces an alcohol;
  (b) contacting the recombinant host cell with one or more carbon substrates under conditions wherein the alcohol is produced; and
  (c) recovering the alcohol.

13. The process of claim 12, wherein the alcohol is selected from methanol, ethanol, propanol, butanol, pentanol, and hexanol.

* * * * *